US010487123B2

(12) United States Patent
Baum et al.

(10) Patent No.: US 10,487,123 B2
(45) Date of Patent: *Nov. 26, 2019

(54) CHIMERIC INSECTICIDAL PROTEINS TOXIC OR INHIBITORY TO LEPIDOPTERAN PESTS

(71) Applicant: Monsanto Technology LLC, St. Louis, MO (US)

(72) Inventors: James A. Baum, Webster Groves, MO (US); Thomas A. Cerruti, Newton, MA (US); Crystal L. Dart, Norton, MA (US); Leigh H. English, Chesterfield, MO (US); Stanislaw Flasinski, Chesterfield, MO (US); Xiaoran Fu, Belmont, MA (US); Victor M. Guzov, Cambridge, MA (US); Arlene R. Howe, Chesterfield, MO (US); Jay P. Morgenstern, Boston, MA (US); James K. Roberts, Chesterfield, MO (US); Sara A. Salvador, Wildwood, MO (US); Jinling Wang, Belmont, MA (US)

(73) Assignee: Monsanto Technology LLC, St. Louis, MO (US)

(*) Notice: Subject to any disclaimer, the term of this patent is extended or adjusted under 35 U.S.C. 154(b) by 220 days.

This patent is subject to a terminal disclaimer.

(21) Appl. No.: 15/656,616

(22) Filed: Jul. 21, 2017

(65) Prior Publication Data

US 2017/0327547 A1 Nov. 16, 2017

Related U.S. Application Data

(63) Continuation-in-part of application No. 14/884,469, filed on Oct. 15, 2015, now Pat. No. 10,233,217.

(60) Provisional application No. 62/064,989, filed on Oct. 16, 2014.

(51) Int. Cl.
*C07K 14/325* (2006.01)
*C12N 15/82* (2006.01)
*A01N 63/02* (2006.01)
*A01N 37/46* (2006.01)
*C12N 15/62* (2006.01)

(52) U.S. Cl.
CPC .......... *C07K 14/325* (2013.01); *A01N 37/46* (2013.01); *A01N 63/02* (2013.01); *C12N 15/8286* (2013.01); *C07K 2319/00* (2013.01); *C12N 15/62* (2013.01); *Y02A 40/162* (2018.01)

(58) Field of Classification Search
None
See application file for complete search history.

(56) References Cited

U.S. PATENT DOCUMENTS

| 5,188,642 | A | 2/1993 | Shah et al. |
| 5,273,746 | A * | 12/1993 | Payne .............. A01N 63/00 424/93.2 |
| 5,312,910 | A | 5/1994 | Kishore et al. |
| 5,500,365 | A | 3/1996 | Fischhoff et al. |
| 5,510,471 | A | 4/1996 | Lebrun et al. |
| 5,627,061 | A | 5/1997 | Barry et al. |
| 5,633,435 | A | 5/1997 | Barry et al. |
| 5,633,448 | A | 5/1997 | Lebrun et al. |
| 5,728,925 | A | 3/1998 | Herrera-Estrella et al. |
| 5,880,275 | A | 3/1999 | Fischhoff et al. |
| 6,017,534 | A | 1/2000 | Marlvar et al. |
| 6,033,874 | A | 3/2000 | Baum et al. |
| 6,204,246 | B1 | 3/2001 | Bosch et al. |
| 6,501,009 | B1 | 12/2002 | Romano |
| 6,713,063 | B1 | 3/2004 | Malvar et al. |
| 6,962,705 | B2 | 11/2005 | Malvar et al. |
| 7,064,249 | B2 | 6/2006 | Corbin et al. |
| 7,070,982 | B2 | 7/2006 | Malvar et al. |
| 7,193,133 | B2 | 3/2007 | Lassner et al. |
| 7,510,878 | B2 | 3/2009 | Abad et al. |
| 7,772,465 | B2 | 8/2010 | Abad et al. |
| 7,812,129 | B1 | 10/2010 | Abad et al. |
| 8,344,207 | B2 | 1/2013 | Bogdanova et al. |
| 8,609,936 | B2 | 12/2013 | Baum et al. |
| 2006/0021087 | A1 | 1/2006 | Baum et al. |
| 2006/0112447 | A1 | 5/2006 | Bogdanova et al. |
| 2008/0172762 | A1 | 7/2008 | Cerf et al. |
| 2008/0256667 | A1 | 10/2008 | Dersch et al. |
| 2008/0280361 | A1 | 11/2008 | Calabotta et al. |

(Continued)

FOREIGN PATENT DOCUMENTS

| EP | 0189707 | A2 | 8/1986 |
| EP | 0218571 | A2 | 4/1987 |

(Continued)

OTHER PUBLICATIONS

Baig et al., "cry Genes profiling and the toxicity of isolates of *Bacillus thuringiensis* from soil samples against American bollworm, *Helicoverpa armigera*," Journal of Applied Microbiology, 109:1967-1978 (2010).

(Continued)

*Primary Examiner* — Mykola V. Kovalenko
(74) *Attorney, Agent, or Firm* — Timothy K. Ball; Carine M. Doyle; Arnold & Porter Kaye Scholer LLP

(57) ABSTRACT

Nucleotide sequences are disclosed that encode novel chimeric insecticidal proteins exhibiting Lepidopteran inhibitory activity. Particular embodiments provide compositions and transformed plants, plant parts, and seeds containing the recombinant nucleic acid molecules encoding one or more of the chimeric insecticidal proteins.

19 Claims, No Drawings

Specification includes a Sequence Listing.

(56) References Cited

U.S. PATENT DOCUMENTS

| | | |
|---|---|---|
| 2008/0282432 A1 | 11/2008 | Duncan et al. |
| 2009/0138985 A1 | 5/2009 | Martinell et al. |
| 2009/0142837 A1 | 6/2009 | Adams, Jr. et al. |
| 2009/0313721 A1 | 12/2009 | Abad et al. |
| 2010/0004176 A1 | 1/2010 | Sampson et al. |
| 2010/0017914 A1 | 1/2010 | Hart et al. |
| 2010/0077507 A1 | 3/2010 | Abad et al. |
| 2010/0077508 A1 | 3/2010 | Abad et al. |
| 2010/0137216 A1 | 6/2010 | Carozzi et al. |
| 2010/0160231 A1 | 6/2010 | Sampson et al. |
| 2010/0192256 A1 | 6/2010 | Abad et al. |
| 2010/0197592 A1 | 8/2010 | Heinrichs |
| 2010/0269221 A1 | 10/2010 | Abad et al. |
| 2010/0317569 A1 | 12/2010 | Lira et al. |
| 2010/0319092 A1 | 12/2010 | Lira et al. |
| 2010/0319093 A1 | 12/2010 | Lira et al. |
| 2011/0030096 A1 | 2/2011 | Lira et al. |
| 2011/0055968 A1 | 3/2011 | Cerf et al. |
| 2011/0112013 A1 | 5/2011 | Abad et al. |
| 2011/0154536 A1 | 6/2011 | Abad et al. |
| 2012/0047606 A1 | 2/2012 | Abad et al. |
| 2012/0117690 A1 | 5/2012 | Cerf et al. |
| 2012/0167259 A1 | 6/2012 | Liu et al. |
| 2012/0192310 A1 | 7/2012 | Abad et al. |
| 2012/0210462 A1 | 8/2012 | Bermudez et al. |
| 2012/0233726 A1 | 9/2012 | Abad et al. |
| 2013/0055469 A1 | 2/2013 | Sampson et al. |
| 2013/0097735 A1 | 4/2013 | Bowen et al. |
| 2013/0104259 A1 | 4/2013 | Sampson et al. |
| 2013/0117884 A1 | 5/2013 | Hargiss et al. |
| 2013/0167264 A1 | 6/2013 | Sampson et al. |
| 2013/0219570 A1 | 8/2013 | Lira et al. |
| 2013/0269060 A1 | 10/2013 | Baum et al. |
| 2013/0303440 A1 | 11/2013 | Sampson et al. |
| 2013/0310543 A1 | 11/2013 | Sampson et al. |
| 2014/0007292 A1 | 1/2014 | Cerf et al. |
| 2014/0033361 A1 | 1/2014 | Altier et al. |
| 2014/0033363 A1 | 1/2014 | Sampson |
| 2014/0196175 A1 | 7/2014 | Sampson et al. |
| 2014/0223599 A1 | 8/2014 | Sampson et al. |
| 2014/0245491 A1 | 8/2014 | Sampson et al. |
| 2014/0298538 A1 | 10/2014 | Heinrichs et al. |
| 2014/0366227 A1 | 12/2014 | Gatehouse et al. |
| 2014/0373195 A1 | 12/2014 | Sampson et al. |

FOREIGN PATENT DOCUMENTS

| | | |
|---|---|---|
| EP | 0508909 A1 | 10/1992 |
| EP | 0924299 A1 | 6/1999 |
| WO | WO 1999/024581 A2 | 5/1999 |
| WO | WO 2001/014562 A1 | 3/2001 |
| WO | WO 2001/019859 A2 | 3/2001 |
| WO | WO 2002/014517 A1 | 2/2002 |
| WO | WO 2004/020636 A1 | 3/2004 |
| WO | WO 2011/075588 A1 | 6/2011 |
| WO | WO 2014/008054 A2 | 1/2014 |
| WO | WO 2014/055881 A1 | 4/2014 |

OTHER PUBLICATIONS

Bravo et al., "Mode of action of *Bacillus thuringiensis* Cry and Cyt toxins and their potential for insect control," Toxins, 49:423-435 (2007).

Database UniProt, Database accession No. D9U3MO (2010).

De Maagd et al., "*Bacillus thuringiensis* delta-endotoxin Cry1C domain III Can Function as a Specificity Determinant for *Spodoptera exigua* in Different, but Not All, Cry1-Cry1C Hybrids," Applied and Environmental Microbiology, 66(4):1559-1563 (2000).

Della-Cioppa et al., "Translocation of the precursor of 5-enolpyruvylshikimate-3-phosphate synthase into chloroplasts of higher plants in vitro," Proc. Natl. Acad. Sci. USA, 83:6873-6877 (1986).

International Search Report dated Jun. 6, 2016, in International Patent Application No. PCT US2015/055800.

IUPAC-IUB Joint Commission on Biochemical Nomenclature, "Nomenclature and Symbolism for Amino Acids and Peptides," Eur. J. Biochem. 138:9-37 (1984).

James, "Global Status of Commercialized Biotech/GM Crops: 2012," ISAAA, Brief No. 44 (2012).

Klee et al., "Cloning of an *Arabidopsis thaliana* gene encoding 5-enolpyruvylshikimate-3-phosphate synthase: sequence analysis and manipulation to obtain glyphosate-tolerant plants," Mol Gen Genet, 210:437-442 (1987).

Knight et al., "A Strategy for Shuffling Numerous *Bacillus thuringiensis* Crystal Protein Domains," Journal of Economic Entomology, 97:1805-1813 (2004).

Lucena et al., "Molecular Approaches to Improve the Insecticidal Activity of Bacillus thuringiensis Cry toxins," Toxins, 6(8):2393-2423 (2014).

Pardo-Lopez et al., "*Bacillus thuringiensis* insecticidal three-domain Cry toxins: mode of action, insect resistance and consequences for crop protection," FEMS Microbiology Reviews, 37:3-22 (2013).

Thompson et al., "CLUSTAL W: improving the sensitivity of progressive multiple sequence alignment through sequence weighting, position-specific gap penalties and weight matrix choice," Nucleic Acids Research, 22:4673-4680 (1994).

\* cited by examiner

CHIMERIC INSECTICIDAL PROTEINS TOXIC OR INHIBITORY TO LEPIDOPTERAN PESTS

REFERENCE TO RELATED APPLICATION

This application is a continuation-in-part of U.S. patent application Ser. No. 14/884,469 filed Oct. 15, 2015, which claims the benefit of U.S. provisional application Ser. No. 62/064,989, filed Oct. 16, 2014, which is herein incorporated by reference in its entirety.

INCORPORATION OF SEQUENCE LISTING

A computer readable form of the Sequence Listing is filed with this application by electronic submission and is incorporated into this application by reference in its entirety. The Sequence Listing is contained in the file created on Jul. 21, 2017, having the file name P34470US00_Sequence Listing.txt, and which is 898,272 bytes in size (as measured in the MS-Windows® operating system).

FIELD OF THE INVENTION

The invention generally relates to the field of insect inhibitory proteins. A novel class of chimeric insecticidal proteins exhibiting insect inhibitory activity against agriculturally-relevant pests of crop plants and seeds is disclosed in this application. In particular, the disclosed class of proteins exhibits insecticidal activity against the Lepidopteran order of insect pests. Plants, plant parts, and seeds containing a recombinant nucleic acid molecule encoding one or more of the disclosed toxin proteins are provided.

BACKGROUND OF THE INVENTION

Improving crop yield from agriculturally-significant plants including, among others, corn, soybean, sugarcane, rice, wheat, vegetables, and cotton, has become increasingly important. In addition to the growing need for agricultural products to feed, clothe and provide energy for a growing human population, climate-related effects and pressure from the growing population to use land other than for agricultural practices are predicted to reduce the amount of arable land available for farming. These factors have led to grim forecasts with respect to food security, particularly in the absence of major improvements in plant biotechnology and agronomic practices. In light of these pressures, environmentally sustainable improvements in technology, agricultural techniques, and pest management are vital tools to expand crop production on the limited amount of arable land available for farming.

Insects, particularly insects within the order Lepidoptera, are considered a major cause of damage to field crops, thereby decreasing crop yields in infested areas. Lepidopteran pest species which negatively impact agriculture include, but are not limited to, fall armyworm (*Spodoptera frugiperda*), beet armyworm (*Spodoptera exigua*), bertha armyworm (*Mamestra configurata*), black cutworm (*Agrotis ipsilon*), cabbage looper (*Trichoplusia ni*), soybean looper (*Chrysodeixis includens*), velvetbean caterpillar (*Anticarsia gemmatalis*), green cloverworm (*Hypena scabra*), tobacco budworm (*Heliothis virescens*), granulate cutworm (*Agrotis subterranea*), armyworm (*Pseudaletia unipuncta*), western cutworm (*Agrotis orthogonia*), European corn borer (*Ostrinia nubilalis*), navel orangeworm (*Amyelois transitella*), corn root webworm (*Crambus caliginosellus*), sod webworm (*Herpetogramma licarsisalis*), sunflower moth (*Homoeosoma electellum*), lesser cornstalk borer (*Elasmopalpus lignosellus*), codling moth (*Cydia pomonella*), grape berry moth (*Endopiza viteana*), oriental fruit moth (*Grapholita molesta*), sunflower bud moth (*Suleima helianthana*), diamondback moth (*Plutella xylostella*), pink bollworm (*Pectinophora gossypiella*), pink stem borer (*Sesamia inferens*), gypsy moth (*Lymantria dispar*), cotton leaf worm (*Alabama argillacea*), fruit tree leaf roller (*Archips argyrospila*), European leafroller (*Archips rosana*), Asiatic rice borer, or rice stem borer (*Chilo suppressalis*), rice leaf roller (*Cnaphalocrocis medinalis*), corn root webworm (*Crambus caliginosellus*), bluegrass webworm (*Crambus teerrellus*), southwestern corn borer (*Diatraea grandiosella*)), sugarcane borer (*Diatraea saccharalis*), spiny bollworm (*Earias insulana*), spotted bollworm (*Earias vittella*), Old World cotton bollworm (*Helicoverpa armigera*), corn earworm, soy podworm or cotton bollworm (*Helicoverpa zea*), sod webworm (*Herpetogramma licarsisalis*), European grape vine moth (*Lobesia botrana*), citrus leafminer (*Phyllocnistis citrella*), large white butterfly (*Pieris brassicae*), imported cabbageworm, or small white butterfly (*Pieris rapae*), tobacco cutworm, or cluster caterpillar (*Spodoptera litura*), and tomato leafminer (*Tuta absoluta*).

Historically, the intensive application of synthetic chemical insecticides was relied upon as the pest control agent in agriculture. Concerns for the environment and human health, in addition to emerging resistance issues, stimulated the research and development of biological pesticides. This research effort led to the progressive discovery and use of various entomopathogenic microbial species, including bacteria.

The biological control paradigm shifted when the potential of entomopathogenic bacteria, especially bacteria belonging to the genus *Bacillus*, was discovered and developed as a biological pest control agent. Strains of the bacterium *Bacillus thuringiensis* (Bt) have been used as a source for insecticidal proteins since it was discovered that Bt strains show a high toxicity against specific insects. Bt strains are known to produce delta-endotoxins that are localized within parasporal crystalline inclusion bodies at the onset of sporulation and during the stationary growth phase (e.g., Cry proteins), and are also known to produce secreted insecticidal protein. Upon ingestion by a susceptible insect, delta-endotoxins as well as secreted toxins exert their effects at the surface of the midgut epithelium, disrupting the cell membrane, leading to cell disruption and death. Genes encoding insecticidal proteins have also been identified in bacterial species other than Bt, including other *Bacillus* and a diversity of other bacterial species, such as *Brevibacillus laterosporus*, *Lysinibacillus sphaericus* ("Ls" formerly known as *Bacillus sphaericus*) and *Paenibacillus popilliae*.

Crystalline and secreted soluble insecticidal protein toxins are highly specific for their hosts and have gained worldwide acceptance as alternatives to chemical insecticides. For example, insecticidal toxin proteins have been employed in various agricultural applications to protect agriculturally important plants from insect infestations, decrease the need for chemical pesticide applications, and increase yields. Insecticidal toxin proteins are used to control agriculturally-relevant pests of crop plants by mechanical methods, such as spraying to disperse microbial formulations containing various bacteria strains onto plant surfaces, and by using genetic transformation techniques to produce transgenic plants and seeds expressing insecticidal toxin protein.

The use of transgenic plants expressing insecticidal proteins has been globally adopted. For example, in 2012, 26.1 million hectares were planted with transgenic crops expressing Bt toxins (James, C., Global Status of Commercialized Biotech/GM Crops: 2012. ISAAA Brief No. 44). The global use of transgenic insect-protected crops and the limited number of insecticidal proteins used in these crops has created a selection pressure for existing insect alleles that impart resistance to the currently-utilized insecticidal proteins.

The development of resistance in target pests to insecticidal proteins creates the continuing need for discovery and development of new forms of insecticidal proteins that are useful for managing the increase in insect resistance to transgenic crops expressing insecticidal proteins. New insecticidal proteins with improved efficacy and which exhibit control over a broader spectrum of susceptible insect species will reduce the number of surviving insects which can develop resistance alleles. In addition, the use in one plant of two or more transgenic insecticidal proteins toxic to the same insect pest and displaying different modes of action reduces the probability of resistance in any single target insect species.

Consequently, there is a critical need to identify additional insecticidal proteins with improved insecticidal properties such as increased efficacy against a broader spectrum of target insect pests species and different modes of action compared to the toxins currently used in agricultural practices. To meet this need, the present invention discloses novel Cry1 chimeric insecticidal proteins that exhibit activity against significant target Lepidopteran pest species.

Members of the family of Cry1 crystal proteins are known in the art to exhibit bioactivity against Lepidopteran pests. The precursor form of Cry 1 crystal proteins consists of two approximately equal-sized segments. The carboxy-terminal portion of the precursor protein, known as the protoxin segment, stabilizes crystal formation and exhibits no insecticidal activity. The amino-terminal half of the precursor protein comprises the toxin segment of the Cry1 protein and, based on alignment of conserved or substantially conserved sequences within Cry1 family members, can be further sub-divided into three structural domains, domain I, domain II, and domain III. Domain I comprises about the first third of the active toxin segment and has been shown to be essential for channel formation. Domains II and III have both been implicated in receptor binding and insect species specificity, depending on the insect and insecticidal protein being examined.

The likelihood of arbitrarily creating a chimeric protein with enhanced properties from the assortment of the domain structures of the numerous native insecticidal proteins known in the art is remote. This is a result of the complex nature of protein structure, oligomerization, and activation (including correct proteolytic processing of the chimeric precursor, if expressed in such a form) required to release an insecticidal protein segment. Only by careful selection of protoxins and specific targets within each parental protein for the creation of a chimeric structure can functional chimeric insecticidal toxins be constructed that exhibit improved insecticidal activity in comparison to the parental proteins from which the chimeras are derived. It is known in the art that reassembly of the protoxin and toxin domains I, II and III of any two or more toxins that are different from each other often results in the construction of proteins that exhibit faulty crystal formation or the complete lack of any detectable insecticidal activity directed to a preferred target insect pest species. Only by trial and error are effective insecticidal chimeras designed, and even then, the skilled artisan is not certain to end up with a chimera that exhibits insecticidal activity that is equivalent to or improved in comparison to any single parental toxin protein from which the constituent protoxin or toxin domains of the chimera may have been derived. For example, the literature reports numerous examples of the construction or assembly of chimeric proteins from two or more crystal protein precursors. See, e.g. Jacqueline S. Knight, et al. "A Strategy for Shuffling Numerous *Bacillus thuringiensis* Crystal Protein Domains." *J. Economic Entomology,* 97 (6) (2004): 1805-1813; Bosch, et al. (U.S. Pat. No. 6,204,246); Malvar and Gilmer (U.S. Pat. No. 6,017,534). In each of these examples, many of the resultant chimeras failed to exhibit insecticidal or crystal forming properties that were equivalent to or improved in comparison to the precursor proteins from which the components of the chimeras were derived.

SUMMARY OF THE INVENTION

Recombinant nucleic acid molecules are provided that encode chimeric insecticidal proteins toxic to Lepidopteran species of plant pests. Each of the chimeric insecticidal proteins can be used alone or in combination with each other and with other insecticidal proteins and insect inhibitory agents in formulations and in planta; thus providing alternatives to insecticidal proteins and insecticidal chemistries currently in use in agricultural systems.

In certain embodiments disclosed herein is a chimeric insecticidal protein comprising an amino acid sequence as set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111. In certain embodiments disclosed herein is a chimeric insecticidal protein comprising SEQ ID NO: 93. This chimeric insecticidal protein exhibits inhibitory activity against an insect species of the order Lepidoptera such as, but not limited to, *Anticarsia gemmatalis, Diatraea saccharalis, Elasmopalpus lignosellus, Helicoverpa zea, Heliothis virescens, Chrysodeixis includens, Spodoptera cosmioides, Spodoptera eridania, Spodoptera frugiperda, Spodoptera exigua, Helicoverpa armigera, Spodoptera litura, Pectinophora gossypiella, Diatraea grandiosella, Earias vitella, Helicoverpa gelotopeon*, and *Rachiplusia nu.*

In another embodiment, a polynucleotide encoding a chimeric insecticidal protein, wherein the polynucleotide is operably linked to a heterologous promoter and the chimeric insecticidal protein comprises the amino acid sequence as set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111 is disclosed. In another embodiment, a polynucleotide encoding a chimeric insecticidal protein, wherein the polynucleotide is operably linked to a heterologous promoter and the chimeric insecticidal protein comprises the amino acid sequence SEQ ID NO: 93. A polynucleotide encoding a chimeric insecticidal protein, wherein the polynucleotide comprises a nucleotide sequence that optionally: hybridizes under stringent conditions to the reverse complement of the polynucleotide sequence as set forth in any of SEQ ID NOs:1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, or 130; or encodes the chimeric insecticidal protein comprising an amino acid sequence as set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111 is also contemplated. A polynucleotide encoding a chimeric insecticidal protein, wherein the polynucleotide comprises a nucleotide sequence that optionally hybridizes under stringent conditions to the reverse complement of a polynucleotide sequence of SEQ ID NO: 92 or 122, or encodes the chimeric insecticidal protein comprises the amino acid sequence SEQ ID NO: 93.

In other embodiments disclosed herein is a host cell comprising the polynucleotide set forth in any of SEQ ID NO: 1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, or 130; wherein the host cell is selected from the group consisting of a bacterial host cell or a plant host cell. In other embodiments disclosed herein is a host cell comprising the polynucleotide SEQ ID NOs: 92 or 122, wherein the host cell is selected from the group consisting of a bacterial host cell or a plant host cell. Contemplated bacterial host include *Agrobacterium, Rhizobium, Bacillus, Brevibacillus, Escherichia, Pseudomonas, Klebsiella*, and *Erwinia*; and wherein the *Bacillus* species is a *Bacillus cereus* or a *Bacillus thuringiensis*, said *Brevibacillus* is a *Brevibacillus laterosperous*, and said *Escherichia* is an *Escherichia coli*. Contemplated plant cells include monocots and dicots.

Other embodiments disclosed herein include insect inhibitory compositions comprising a chimeric insecticidal protein comprising an amino acid sequence as set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111. Other embodiments disclosed herein include insect inhibitory compositions comprising a chimeric insecticidal protein comprising an amino acid sequence SEQ ID NO: 93. In certain embodiments, the insect inhibitory composition further comprises at least one insect inhibitory agent different from the chimeric insecticidal protein. Contemplated insect inhibitory agents different from the chimeric insecticidal protein include an insect inhibitory protein, an insect inhibitory dsRNA molecule, and an insect inhibitory chemistry. These insect inhibitory agents different from the chimeric insecticidal protein can exhibit activity against one or more pest species of the orders Lepidoptera, Coleoptera, Hemiptera, Homoptera, or Thysanoptera.

In yet another embodiment, disclosed herein is a seed comprising an insect inhibitory effective amount of: a chimeric insecticidal protein comprising the amino acid sequence as set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111; or a polynucleotide set forth in any of SEQ ID NOs:1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, or 130. Another embodiment, disclosed herein is a seed comprising an insect inhibitory effective amount of a chimeric insecticidal protein comprising the amino acid sequence SEQ ID NO: 93, or a polynucleotide of SEQ ID NOs: 92 or 122.

Methods of controlling a Lepidopteran pest comprising contacting the Lepidopteran pest with an inhibitory amount of a chimeric insecticidal protein of the invention are also contemplated.

In another embodiment, disclosed herein is a transgenic plant cell, plant or plant part comprising a chimeric insecticidal protein, wherein: the chimeric insecticidal protein comprises any amino acid sequence set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111; or the chimeric insecticidal protein comprises a protein having: at least 94% identical to SEQ ID NOs:21, 10; at least 93% identical to SEQ ID NO:28; at least 87% identical to SEQ ID NO:7; at least 90% identity to SEQ ID NO:4; at least 91% identical to SEQ ID NO:13; at least 64% identical to SEQ ID NO:16; at least 66% identical to SEQ ID NO:19; at least 86% identical to SEQ ID NO:23; at least 91% identical to SEQ ID NO:25; at least 94% identical to SEQ ID NO:30; at least 91% identical to SEQ ID NO:33; at least 64% identical to SEQ ID NO:36; at least 66% identical to SEQ ID NO:39; at least 94% identical to SEQ ID NO:41; at least 84% identical to SEQ ID NO:43; at least 93% identical to SEQ ID NO:45; at least 94% identical to SEQ ID NO:47; at least 91% identical to SEQ ID NO:50; or at least 93% identical to SEQ ID NO:53; or at least 87% identity to SEQ ID NOs:85, 93, 105; or at least 85% identity to SEQ ID NOs:55, 57, 59, 61, 63, 65, 67, 69, 71, 73, 75, 77, 79; or at least 88% identity to SEQ ID NOs: 91, 87, 89; or at least 89% identity to SEQ ID NOs: 107, 111; or at least 90% identity to SEQ ID NO: 97; at least 91% identity to SEQ ID NO:109; or at least 93% identity to SEQ ID NO:83; or at least 94% identity to SEQ ID NOs:91 or 103; or at least 95% identity to SEQ ID NOs:95, 101; or at least 98% identity to SEQ ID NO:99. In another embodiment disclosed herein, is a transgenic plant cell, plant or plant part comprising a chimeric insecticidal protein, wherein: the chimeric insecticidal protein comprises the amino acid sequence of SEQ ID NO:93, or the chimeric insecticidal protein comprises a protein having at least 87% identity to SEQ ID NO:93. Methods of controlling a Lepidopteran pest which comprise exposing the pest to this transgenic plant cell, plant or plant part, wherein said plant cell, plant or plant part expresses a Lepidopteran inhibitory amount of the chimeric insecticidal protein are also contemplated.

In other embodiments herein, commodity products derived from the plant cell, plant, or plant part wherein the product comprises a detectable amount of the chimeric insecticidal protein are provided. Contemplated commodity products include plant biomass, oil, meal, animal feed, flour, flakes, bran, lint, hulls, and processed seed.

Yet another method disclosed herein is a method of producing a seed comprising a chimeric insecticidal protein, the method comprising: planting at least one seed comprising a chimeric insecticidal protein; growing plants from said seed; and harvesting seed from said plants, wherein said harvested seed comprises the chimeric insecticidal protein.

Recombinant polynucleotide molecules encoding a chimeric insecticidal protein, comprising a nucleotide sequence selected from the group consisting of SEQ ID NOs:1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, or 130; recombinant polynucleotide molecules encoding a chimeric insecticidal protein comprising a nucleotide sequence of SEQ ID NOs:92 or 122; and optionally a polynucleotide sequence encoding an insect inhibitory agent different from the chimeric insecticidal protein are also contemplated herein.

Another recombinant nucleic acid molecule contemplated herein comprises a heterologous promoter operably linked to a polynucleotide segment encoding a chimeric insecticidal proteins, wherein: the chimeric insecticidal protein comprises any amino acid sequence set forth in any of SEQ ID NOs: 21, 10, 28, 7, 4, 13, 16, 19, 23, 25, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, or 111; or the chimeric insecticidal protein comprises a protein having: at least 94% identical to SEQ ID NOs:21, 10; at least 93% identical to SEQ ID NO:28; at least 87% identical to SEQ ID NO:7; at least 90% identity to SEQ ID NO:4; at least 91% identical to SEQ ID NO:13; at least 64% identical to SEQ ID NO:16; at least 66% identical to SEQ ID NO:19; at least 86% identical to SEQ ID NO:23; at least 91% identical to SEQ ID NO:25; at least 94% identical to SEQ ID NO:30; at least 91% identical to SEQ ID NO:33; at least 64% identical to SEQ ID NO:36; at least 66% identical to SEQ ID NO:39; at least 94% identical to SEQ ID NO:41; at least 84% identical to SEQ ID NO:43; at least 93% identical to SEQ ID NO:45; at least 94% identical to SEQ ID NO:47; at least 91% identical to SEQ ID NO:50; or at least 93% identical to SEQ ID NO:53; or at least 87% identity to SEQ ID NOs:85, 93, 105; or at least 85% identity to SEQ ID NOs:55, 57, 59, 61, 63, 65, 67, 69, 71, 73, 75, 77, 79; or at least 88% identity to SEQ ID NOs:91, 87, 89; or at least 89% identity to SEQ ID NOs:107, 111; or at least 90% identity to SEQ ID NO:97; or at least 91% identity to SEQ ID NO:109; or at least 93% identity to SEQ ID NO:83; or at least 94% identity to SEQ ID NOs:91, 103; or at least 95% identity to SEQ ID NOs:95, 101; or at least 98% identity to SEQ ID NO:99; or the polynucleotide segment hybridizes to a polynucleotide having a nucleotide sequence as set forth in any of SEQ ID NOs: 1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, or 130. Another recombinant nucleic acid molecule contemplated herein comprises a heterologous promoter operably linked to a polynucleotide segment encoding a chimeric insecticidal proteins, wherein the chimeric insecticidal protein comprises the amino acid sequence of SEQ ID NO:93, or the chimeric insecticidal protein comprises a protein having at least 87% identity to SEQ ID NO:93; or the polynucleotide segment hybridizes to a polynucleotide having a nucleotide sequence of SEQ ID NOs:92 or 122

Other embodiments, features, and advantages of the invention will be apparent from the following detailed description, examples, and claims.

Brief Description of the Sequences

SEQ ID NO: 1 is a recombinant DNA sequence encoding TIC1100 used for expression in a bacterial cell.
SEQ ID NO: 2 is a synthetic DNA sequence encoding TIC1100 for expression in a plant cell.
SEQ ID NO: 3 is a synthetic DNA sequence encoding TIC1100 for expression in a plant cell.
SEQ ID NO: 4 is the amino acid sequence of TIC1100.
SEQ ID NO: 5 is a recombinant DNA sequence encoding TIC860 used for expression in a bacterial cell.
SEQ ID NO: 6 is a synthetic DNA sequence encoding TIC860 for expression in a plant cell.
SEQ ID NO: 7 is the amino acid sequence of TIC860.
SEQ ID NO: 8 is a recombinant DNA sequence encoding TIC867 used for expression in a bacterial cell.
SEQ ID NO: 9 is a synthetic DNA sequence encoding TIC867 for expression in a plant cell.
SEQ ID NO: 10 is the amino acid sequence of TIC867.
SEQ ID NO: 11 is a recombinant DNA sequence encoding TIC867_20 used for expression in a bacterial cell.
SEQ ID NO: 12 is a synthetic DNA sequence encoding TIC867_20 for expression in a plant cell.
SEQ ID NO: 13 is the amino acid sequence of TIC867_20.
SEQ ID NO: 14 is a recombinant DNA sequence encoding TIC867_21 used for expression in a bacterial cell.
SEQ ID NO: 15 is a synthetic DNA sequence encoding TIC867_21 for expression in a plant cell.
SEQ ID NO: 16 is the amino acid sequence of TIC867_21.
SEQ ID NO: 17 is a recombinant DNA sequence encoding TIC867_22 used for expression in a bacterial cell.
SEQ ID NO: 18 is a synthetic DNA sequence encoding TIC867_22 for expression in a plant cell.
SEQ ID NO: 19 is the amino acid sequence of TIC867_22.
SEQ ID NO: 20 is a synthetic DNA sequence encoding TIC867_23 for expression in the plant cell.
SEQ ID NO: 21 is the amino acid sequence of TIC867_23.
SEQ ID NO: 22 is a synthetic DNA sequence encoding TIC867_24 for expression in a plant cell.
SEQ ID NO: 23 is the amino acid sequence of TIC867_24.
SEQ ID NO: 24 is a synthetic DNA sequence encoding TIC867_24 for expression in a plant cell.
SEQ ID NO: 25 is the amino acid sequence of TIC867_25.
SEQ ID NO: 26 is a recombinant DNA sequence encoding TIC868 used for expression in a bacterial cell.
SEQ ID NO: 27 is a synthetic DNA sequence encoding TIC868 for expression in a plant cell.
SEQ ID NO: 28 is the amino acid sequence of TIC868.
SEQ ID NO: 29 is a synthetic DNA sequence encoding TIC868_9 for expression in a plant cell.
SEQ ID NO: 30 is the amino acid sequence of TIC868_9.
SEQ ID NO: 31 is a recombinant DNA sequence encoding TIC868_10 used for expression in a bacterial cell.
SEQ ID NO: 32 is a synthetic DNA sequence for expression in the plant cell encoding the TIC868 variant, TIC868_10.
SEQ ID NO: 33 is the amino acid sequence of TIC868_10.
SEQ ID NO: 34 is a recombinant DNA sequence encoding TIC868_11 used for expression in a bacterial cell.
SEQ ID NO: 35 is a synthetic DNA sequence encoding TIC868_11 for expression in a plant cell.
SEQ ID NO: 36 is the amino acid sequence of TIC868_11.
SEQ ID NO: 37 is a recombinant DNA sequence encoding TIC868_12 used for expression in a bacterial cell.
SEQ ID NO: 38 is a synthetic DNA sequence encoding TIC868_12 for expression in the plant cell.

SEQ ID NO: 39 is the amino acid sequence of TIC868_12.

SEQ ID NO: 40 is a synthetic DNA sequence encoding TIC868_13 for expression in the plant cell.

SEQ ID NO: 41 is the amino acid sequence of TIC868_13.

SEQ ID NO: 42 is a synthetic DNA sequence encoding TIC868_14 for expression in a plant cell.

SEQ ID NO: 43 is the amino acid sequence of TIC868_14.

SEQ ID NO: 44 is a synthetic DNA sequence encoding TIC868_15 for expression in a plant cell.

SEQ ID NO: 45 is the amino acid sequence of TIC868_15.

SEQ ID NO: 46 is a synthetic DNA sequence encoding TIC868_29 for expression in a plant cell.

SEQ ID NO: 47 is the amino acid sequence of TIC868_29.

SEQ ID NO: 48 is a recombinant DNA sequence encoding TIC869 used for expression in a bacterial cell.

SEQ ID NO: 49 is a synthetic DNA sequence encoding TIC869 for expression in a plant cell.

SEQ ID NO: 50 is the amino acid sequence of TIC869.

SEQ ID NO: 51 is a recombinant DNA sequence encoding TIC836 used for expression in a bacterial cell.

SEQ ID NO: 52 is a synthetic DNA sequence encoding TIC836 for expression in a plant cell.

SEQ ID NO: 53 is the amino acid sequence of TIC836.

SEQ ID NO: 54 is a DNA sequence encoding a chimeric TIC713 amino acid sequence.

SEQ ID NO: 55 is the TIC713 amino acid sequence translated from the open reading frame set forth in SEQ ID NO: 54.

SEQ ID NO: 56 is a DNA sequence encoding a chimeric TIC843 amino acid sequence.

SEQ ID NO: 57 is the TIC843 amino acid sequence translated from the open reading frame set forth in SEQ ID NO: 56.

SEQ ID NO: 58 is a DNA sequence encoding a chimeric TIC862 amino acid sequence.

SEQ ID NO: 59 is the TIC862 amino acid sequence translated from the open reading frame set forth in SEQ ID NO: 58.

SEQ ID NO: 60 is a DNA sequence encoding a chimeric TIC1099 amino acid sequence.

SEQ ID NO: 61 is the TIC1099 amino acid sequence translated from the open reading frame set forth in SEQ ID NO: 60.

SEQ ID NO: 62 is a DNA sequence encoding a chimeric TIC1099-T507E amino acid sequence.

SEQ ID NO: 63 is the TIC1099-T507E amino acid sequence translated from the open reading frame set forth in SEQ ID NO: 62.

SEQ ID NO: 64 is a DNA sequence encoding a chimeric TIC1099-R522K amino acid sequence.

SEQ ID NO: 65 is the TIC1099-R522K amino acid sequence translated from the open reading frame set forth in SEQ ID NO: 64.

SEQ ID NO: 66 is a DNA sequence encoding a chimeric TIC1099-K490S amino acid sequence.

SEQ ID NO: 67 is the TIC1099-K490S amino acid sequence translated from the open reading frame set forth in SEQ ID NO: 66.

SEQ ID NO: 68 is a DNA sequence encoding a chimeric TIC1099-T562R amino acid sequence.

SEQ ID NO: 69 is the TIC1099-T562R amino acid sequence translated from the open reading frame set forth in SEQ ID NO: 68.

SEQ ID NO: 70 is a DNA sequence encoding a chimeric TIC1099-S553R amino acid sequence.

SEQ ID NO: 71 is the TIC1099-S553R amino acid sequence translated from the open reading frame set forth in SEQ ID NO: 70.

SEQ ID NO: 72 is a DNA sequence encoding a chimeric TIC1099-G498D amino acid sequence.

SEQ ID NO: 73 is the TIC1099-G498D amino acid sequence translated from the open reading frame set forth in SEQ ID NO: 72.

SEQ ID NO: 74 is a DNA sequence encoding a chimeric TIC1099-K490A amino acid sequence.

SEQ ID NO: 75 is the TIC1099-K490A amino acid sequence translated from the open reading frame set forth in SEQ ID NO: 74.

SEQ ID NO: 76 is a DNA sequence encoding a chimeric TIC1099-E564A amino acid sequence.

SEQ ID NO: 77 is the TIC1099-E564A amino acid sequence translated from the open reading frame set forth in SEQ ID NO: 76.

SEQ ID NO: 78 is a DNA sequence encoding a chimeric TIC1103 amino acid sequence.

SEQ ID NO: 79 is the TIC1103 amino acid sequence translated from the open reading frame set forth in SEQ ID NO: 78.

SEQ ID NO: 80 is a DNA sequence encoding a chimeric TIC1101 amino acid sequence.

SEQ ID NO: 81 is the TIC1101 amino acid sequence translated from the open reading frame set forth in SEQ ID NO: 80.

SEQ ID NO: 82 is a DNA sequence encoding a chimeric TIC845 amino acid sequence.

SEQ ID NO: 83 is the TIC845 amino acid sequence translated from the open reading frame set forth in SEQ ID NO: 82.

SEQ ID NO: 84 is a DNA sequence encoding a chimeric TIC846 amino acid sequence.

SEQ ID NO: 85 is the TIC846 amino acid sequence translated from the open reading frame set forth in SEQ ID NO: 84.

SEQ ID NO: 86 is a DNA sequence encoding a chimeric TIC858 amino acid sequence.

SEQ ID NO: 87 is the TIC858 amino acid sequence translated from the open reading frame set forth in SEQ ID NO: 86.

SEQ ID NO: 88 is a DNA sequence encoding a chimeric TIC865 amino acid sequence.

SEQ ID NO: 89 is the TIC865 amino acid sequence translated from the open reading frame set forth in SEQ ID NO: 88.

SEQ ID NO: 90 is a DNA sequence encoding a chimeric TIC866 amino acid sequence.

SEQ ID NO: 91 is the TIC866 amino acid sequence translated from the open reading frame set forth in SEQ ID NO: 90.

SEQ ID NO: 92 is a DNA sequence encoding a chimeric TIC838 amino acid sequence.

SEQ ID NO: 93 is the TIC838 amino acid sequence translated from the open reading frame set forth in SEQ ID NO: 92.

SEQ ID NO: 94 is a DNA sequence encoding a chimeric TIC839 amino acid sequence.

SEQ ID NO: 95 is the TIC839 amino acid sequence translated from the open reading frame set forth in SEQ ID NO: 94.

SEQ ID NO: 96 is a DNA sequence encoding a chimeric TIC841 amino acid sequence.

SEQ ID NO: 97 is the TIC841 amino acid sequence translated from the open reading frame set forth in SEQ ID NO: 96.

SEQ ID NO: 98 is a DNA sequence encoding a chimeric TIC842 amino acid sequence.

SEQ ID NO: 99 is the TIC842 amino acid sequence translated from the open reading frame set forth in SEQ ID NO: 98.

SEQ ID NO: 100 is a DNA sequence encoding a chimeric TIC850 amino acid sequence.

SEQ ID NO: 101 is the TIC850 amino acid sequence translated from the open reading frame set forth in SEQ ID NO: 100.

SEQ ID NO: 102 is a DNA sequence encoding a chimeric TIC859 amino acid sequence.

SEQ ID NO: 103 is the TIC859 amino acid sequence translated from the open reading frame set forth in SEQ ID NO: 102.

SEQ ID NO: 104 is a DNA sequence encoding a chimeric TIC861 amino acid sequence.

SEQ ID NO: 105 is the TIC861 amino acid sequence translated from the open reading frame set forth in SEQ ID NO: 104.

SEQ ID NO: 106 is a DNA sequence encoding a chimeric TIC848 amino acid sequence.

SEQ ID NO: 107 is the TIC848 amino acid sequence translated from the open reading frame set forth in SEQ ID NO: 106.

SEQ ID NO: 108 is a DNA sequence encoding a chimeric TIC849 amino acid sequence.

SEQ ID NO: 109 is the TIC849 amino acid sequence translated from the open reading frame set forth in SEQ ID NO: 108.

SEQ ID NO: 110 is a DNA sequence encoding a chimeric TIC847 amino acid sequence.

SEQ ID NO: 111 is the TIC847 amino acid sequence translated from the open reading frame set forth in SEQ ID NO: 110.

SEQ ID NO: 112 is a synthetic DNA sequence for expression in the plant cell encoding TIC713.

SEQ ID NO: 113 is a synthetic DNA sequence for expression in the plant cell encoding TIC713.

SEQ ID NO: 114 is a synthetic DNA sequence for expression in the plant cell encoding TIC843.

SEQ ID NO: 115 is a synthetic DNA sequence for expression in the plant cell encoding TIC862.

SEQ ID NO: 116 is a synthetic DNA sequence for expression in the plant cell encoding TIC1099.

SEQ ID NO: 117 is a synthetic DNA sequence for expression in the plant cell encoding TIC1103.

SEQ ID NO: 118 is a synthetic DNA sequence for expression in the plant cell encoding TIC845.

SEQ ID NO: 119 is a synthetic DNA sequence for expression in the plant cell encoding TIC846.

SEQ ID NO: 120 is a synthetic DNA sequence for expression in the plant cell encoding TIC858.

SEQ ID NO: 121 is a synthetic DNA sequence for expression in the plant cell encoding TIC866.

SEQ ID NO: 122 is a synthetic DNA sequence for expression in the plant cell encoding TIC838.

SEQ ID NO: 123 is a synthetic DNA sequence for expression in the plant cell encoding TIC841.

SEQ ID NO: 124 is a synthetic DNA sequence for expression in the plant cell encoding TIC842.

SEQ ID NO: 125 is a synthetic DNA sequence for expression in the plant cell encoding TIC850.

SEQ ID NO: 126 is a synthetic DNA sequence for expression in the plant cell encoding TIC859.

SEQ ID NO: 127 is a synthetic DNA sequence for expression in the plant cell encoding TIC861.

SEQ ID NO: 128 is a synthetic DNA sequence for expression in the plant cell encoding TIC848.

SEQ ID NO: 129 is a synthetic DNA sequence for expression in the plant cell encoding TIC849.

SEQ ID NO: 130 is a synthetic DNA sequence for expression in the plant cell encoding TIC847.

DETAILED DESCRIPTION OF THE INVENTION

The problem in the art of agricultural pest control can be characterized as a need for new insecticidal proteins that are efficacious against target pests, exhibit broad spectrum toxicity against target pest species, are capable of being expressed in plants without causing undesirable agronomic issues, and provide an alternative mode of action compared to current toxins that are used commercially in plants. Novel chimeric insecticidal proteins are disclosed herein, and address each of these needs, particularly against a broad spectrum of Lepidopteran insect pests.

In order to avoid the development of, or circumvent insect resistance against currently used insecticidal proteins, new insecticidal proteins with different modes-of-action (MOA), as well as a broad spectrum and efficacy, are needed for Lepidoptera control. One way to address this need is to discover new insecticidal proteins from different biological sources, preferably from bacteria, fungi or plants. Another approach is to interchange segments between various Bt proteins that exhibit structural similarities to create new chimeric Bt proteins having insect inhibitory properties. The likelihood of creating a chimeric protein with enhanced properties from the re-assortment of the domain structures of numerous native insecticidal crystal proteins known in the art is known in the art to be remote. See, e.g. Jacqueline S. Knight, et al. "A Strategy for Shuffling Numerous *Bacillus thuringiensis* Crystal Protein Domains." *J. Economic Entomology*, 97 (6) (2004): 1805-1813.

Disclosed herein are recombinant nucleic acid molecule sequences that encode novel chimeric insecticidal proteins. These insecticidal proteins address the ongoing need in the art to engineer additional toxic insecticidal proteins with improved insecticidal properties such as increased efficacy against a broader spectrum of target insect pests species and different modes of action. Members of this group of proteins, including the exemplary proteins disclosed herein, exhibit insecticidal activity against Lepidopteran insect pest species.

The term "segment" or "fragment" is used in this application to describe consecutive amino acid or nucleic acid sequences that are shorter than the complete amino acid or nucleic acid sequence describing a disclosed chimeric insecticidal protein. A segment or fragment exhibiting insect inhibitory activity is also disclosed in this application if alignment of such segment or fragment, with the corresponding section of the chimeric insecticidal protein, results in amino acid sequence identity of any fraction percentage from about 65 to about 100 percent between the segment or fragment and the corresponding section of the chimeric insecticidal protein.

Reference in this application to the terms "active" or "activity", "pesticidal activity" or "pesticidal", or "insecticidal activity", "insect inhibitory" or "insecticidal" refer to efficacy of a toxic agent, such as an insecticidal protein, in inhibiting (inhibiting growth, feeding, fecundity, or viability), suppressing (suppressing growth, feeding, fecundity, or viability), controlling (controlling the pest infestation, controlling the pest feeding activities on a particular crop containing an effective amount of the insecticidal protein) or killing (causing the morbidity, mortality, or reduced fecundity of) a pest. These terms are intended to include the result of providing a pesticidally effective amount of an insecticidal protein to a pest where the exposure of the pest to the insecticidal protein results in morbidity, mortality, reduced fecundity, or stunting. These terms also include repulsion of the pest from the plant, a tissue of the plant, a plant part, seed, plant cells, or from the particular geographic location where the plant may be growing, as a result of providing a pesticidally effective amount of the insecticidal protein in or on the plant. In general, pesticidal activity refers to the ability of an insecticidal protein to be effective in inhibiting the growth, development, viability, feeding behavior, mating behavior, fecundity, or any measurable decrease in the adverse effects caused by an insect feeding on this protein, protein fragment, protein segment or polynucleotide of a particular target pest, including but not limited to insects of the order Lepidoptera. The insecticidal protein can be produced by the plant or can be applied to the plant or to the environment within the location where the plant is located. The terms "bioactivity", "effective", "efficacious" or variations thereof are also terms interchangeably utilized in this application to describe the effects of the chimeric insecticidal proteins of the present invention on target insect pests.

A pesticidally effective amount of a toxic agent, when provided in the diet of a target pest, exhibits pesticidal activity when the toxic agent contacts the pest. A toxic agent can be an insecticidal protein or one or more chemical agents known in the art. Insecticidal chemical agents and insecticidal protein agents can be used alone or in combinations with each other. Chemical agents include but are not limited to dsRNA molecules targeting specific genes for suppression in a target pest, organochlorides, organophosphates, carbamates, pyrethroids, neonicotinoids, and ryanoids. Insecticidal protein agents include the chimeric insecticidal proteins set forth in this application, as well as other proteinaceous toxic agents including those that target Lepidopteran pest species, as well as protein toxins that are used to control other plant pests such as Cry proteins available in the art for use in controlling Coleopteran, Thysanopteranm, Hemipteran and Homopteran species.

It is intended that reference to a pest, particularly a pest of a crop plant, means insect pests of crop plants, particularly those Lepidopteran insect pests that are controlled by the disclosed chimeric insecticidal proteins. However, reference to a pest can also include Coleopteran, Hemipteran and Homopteran insect pests of plants, as well as nematodes and fungi when toxic agents targeting these pests are co-localized or present together with the chimeric insecticidal protein, or a protein that is 65 to about 100 percent identical to the chimeric insecticidal protein.

The chimeric insecticidal proteins disclosed herein exhibit insecticidal activity towards insect pests from the Lepidopteran insect species, including adults, pupae, larvae, and neonates, as well as Hemipteran insect species, including adults and nymphs. The insects of the order Lepidoptera include, but are not limited to, armyworms, cutworms, loopers, and heliothines in the Family Noctuidae, e.g., fall armyworm (*Spodoptera frugiperda*), beet armyworm (*Spodoptera exigua*), bertha armyworm (*Mamestra configurata*), black cutworm (*Agrotis ipsilon*), cabbage looper (*Trichoplusia ni*), soybean looper (*Pseudoplusia includens*), velvetbean caterpillar (*Anticarsia gemmatalis*), green cloverworm (*Hypena scabra*), tobacco budworm (*Heliothis virescens*), granulate cutworm (*Agrotis subterranea*), armyworm (*Pseudaletia umpuncta*), western cutworm (*Agrotis orthogonia*); borers, casebearers, webworms, coneworms, cabbageworms and skeletonizers from the Family Pyralidae, e.g., European corn borer (*Ostrinia nubilalis*), navel orangeworm (*Amyelois transitella*), corn root webworm (*Crambus caliginosellus*), sod webworm (*Herpetogramma licarsisalis*), sunflower moth (*Homoeosoma electellum*), lesser cornstalk borer (*Elasmopalpus lignosellus*); leafrollers, budworms, seed worms, and fruit worms in the Family Tortricidae, e.g., codling moth (*Cydia pomonella*), grape berry moth (*Endopiza viteana*), oriental fruit moth (*Grapholita molesta*), sunflower bud moth (*Suleima helianthana*); and many other economically important Lepidoptera, e.g., diamondback moth (*Plutella xylostella*), pink bollworm (*Pectinophora gossypiella*) and gypsy moth (*Lymantria dispar*). Other insect pests of order Lepidoptera include, e.g., *Alabama argillacea* (cotton leaf worm), *Archips argyrospila* (fruit tree leaf roller), *Archips rosana* (European leafroller) and other *Archips* species, *Chilo suppressalis* (Asiatic rice borer, or rice stem borer), *Cnaphalocrocis medinalis* (rice leaf roller), *Crambus caliginosellus* (corn root webworm), *Crambus teterrellus* (bluegrass webworm), *Diatraea grandiosella* (southwestern corn borer), *Diatraea saccharalis* (surgarcane borer), *Earias insulana* (spiny bollworm), *Earias vittella* (spotted bollworm), *Helicoverpa armigera* (American bollworm), *Helicoverpa zea* (corn earworm or cotton bollworm), *Heliothis virescens* (tobacco budworm), *Herpetogramma licarsisalis* (sod webworm), *Lobesia botrana* (European grape vine moth), *Phyllocnistis citrella* (citrus leafminer), *Pieris brassicae* (large white butterfly), *Pieris rapae* (imported cabbageworm, or small white butterfly), *Plutella xylostella* (diamondback moth), *Spodoptera exigua* (beet armyworm), *Spodoptera litura* (tobacco cutworm, cluster caterpillar), and *Tuta absoluta* (tomato leafminer).

Reference in this application to an "isolated DNA molecule", or an equivalent term or phrase, is intended to mean that the DNA molecule is one that is present alone or in combination with other compositions, but not within its natural environment. For example, nucleic acid elements such as a coding sequence, intron sequence, untranslated leader sequence, promoter sequence, transcriptional termination sequence, and the like, that are naturally found within the DNA of the genome of an organism are not considered to be "isolated" so long as the element is within the genome of the organism and at the location within the genome in which it is naturally found. However, each of these elements, and subparts of these elements, would be "isolated" within the scope of this disclosure so long as the element is not within the genome of the organism and at the location within the genome in which it is naturally found. Similarly, a nucleotide sequence encoding an insecticidal protein or any naturally occurring insecticidal variant of that protein would be an isolated nucleotide sequence so long as the nucleotide sequence was not within the DNA of the bacterium from which the sequence encoding the protein is naturally found. A synthetic nucleotide sequence encoding the amino acid sequence of the naturally occurring insecticidal protein would be considered to be isolated for the purposes of this disclosure. For the purposes of this disclosure, any transgenic nucleotide sequence, i.e., the nucleotide sequence of the DNA inserted into the genome of the cells of a plant or bacterium, or present in an extrachromosomal vector, would be considered to be an isolated nucleotide sequence whether it is present within the plasmid or similar structure used to transform the cells, within the genome of the plant or bacterium, or present in detectable amounts in tissues, progeny, biological samples or commodity products derived from the plant or bacterium.

As described further in the Examples, through a chimeragenesis effort about eight hundred and forty four (844) nucleotide sequences that encode chimeric insecticidal proteins were constructed from the protoxin and toxin domains of known insecticidal toxins (referred to herein as the "parent proteins"), and expressed and tested in bioassay for Lepidopteran activity. A small number of the constructed chimeric insecticidal proteins exhibited improved Lepidopteran activity or an enhanced Lepidopteran spectrum compared to the parent proteins from which its toxin components were derived.

These novel chimeric insecticidal proteins with improved Lepidopteran activity or an enhanced Lepidopteran spectrum were constructed from the following insecticidal parent protein protoxin and toxin domains: Cry1Ah (Domain I), Cry1Bb1 (Domains I and II), Cry 1Be2 (Domains I and II), Cry1Ja1 (Domains I and II), Cry1Fa1 (Domains I and II), Cry1Ac (Domain II and protoxin), Cry1Ca (Domain III and protoxin), Cry1Ka (Domain III and protoxin), Cry1Jx (Domain III), Cry1Ab (Domain III), Cry1Ab3 (protoxin), Cry1Da1 (protoxin), Cry4 (protoxin), Cry9 (protoxin), Cry1Be (protoxin), and Cry1Ka (protoxin).

Specifically, the novel chimeric insecticidal proteins of this invention with improved Lepidopteran activity or an enhanced Lepidopteran spectrum comprise the following protoxin and domain combinations: TIC1100/SEQ ID NO:4 (Domain I-Cry1Ah, Domain II-Cry1Ac, Domain III-Cry1Ca, Protoxin-Cry1Ac), TIC860/SEQ ID NO:7 (Domain I-Cry1Bb1, Domain II-Cry1BB1, Domain III-Cry1Ca, Protoxin-Cry1Ac), TIC867/SEQ ID NO:10 (Domain I-Cry1Be2, Domain II-Cry1Be2, Domain III-Cry1Ka, Protoxin-Cry1Ab3), TIC868/SEQ ID NO:28 (Domain I-Cry1Be2, Domain II-Cry1Be2, and Domain III-Cry1Ca, Protoxin-Cry1Ab3), TIC869/SEQ ID NO:50 (Domain I-Cry1Ja1, Domain II-Cry1Ja1, Domain III-Cry1Jx, Protoxin-Cry1Ab3) and TIC836/SEQ ID NO:53 (Domain I-Cry1Fa1, Domain II-Cry1Fa1, Domain III-Cry1Ab, Protoxin-Cry1Ac).

Variants in which amino acid substitutions or alternate protoxin domains were introduced were also constructed for the chimeric insecticidal proteins TIC867 and TIC868. Specifically, these variants of TIC867 and TIC868 comprise the following amino acid substitutions or alternate protoxin domains: TIC867_20/SEQ ID NO:13 (alternate protoxin domain Cry1Da1), TIC867_21/SEQ ID NO:16 (alternate protoxin domain Cry4), TIC867_22/SEQ ID NO:19 (alternate protoxin domain Cry9), TIC867_23/SEQ ID NO:21 (alternate protoxin domain Cry1Be), TIC867_24/SEQ ID NO:23 (alternate protoxin domain Cry1Ka), TIC867_25/SEQ ID NO: 25 (alternate protoxin domain Cry1Ka), TIC868_9/SEQ ID NO:30 (amino acid modification N240S_Y343Q_N349T), TIC868_10/SEQ ID NO:33 (alternate protoxin domain Cry1Da1), TIC868_11/SEQ ID NO:36 (alternate protoxin domain Cry4), TIC868_12/SEQ ID NO:39 (alternate protoxin domain Cry 9), TIC868_13/SEQ ID NO:41 (alternate protoxin domain Cry1Be), TIC868_14/ SEQ ID NO:43 (alternate protoxin domain Cry1Ka), TIC868_15/SEQ ID NO:45 (alternate protoxin domain Cry1Ca), and TIC868_29/SEQ ID NO:47 (amino acid modification Q136Y_Y343Q_N349T).

As demonstrated in the Examples, each of these TIC867 and TIC868 variants altered the Lepidopteran activity and/or reduced the Lepidopteran activity spectrum of the parent chimeric insecticidal protein, thus indicating that the alternate protoxin domain and the amino acid substitutions had a direct consequence on the insecticidal activity and spectrum of the chimeric insecticidal proteins TIC867 and TIC868.

Many of the chimeric insecticidal proteins demonstrate insecticidal activity against multiple Lepidopteran insect pest species. Specifically, the novel chimeric insecticidal proteins disclosed in this application exhibited activity against one or more of the following Lepidopteran insect pests, Velvet bean caterpillar (VBC, *Anticarsia gemmatalis*), Sugarcane borer (SCB, *Diatraea saccharalis*), Lesser cornstalk borer (LSCB, *Elasmopalpus lignosellus*), Corn earworm (CEW, *Helicoverpa zea*), Soybean pod worm (SPW, *Helicoverpa zea*), Cotton bollworm (CBW, *Helicoverpa zea*), Tobacco budworm (TBW, *Heliothis virescens*), Soybean looper (SBL, *Chrysodeixis includens*), Black armyworm (BLAW, *Spodoptera cosmioides*), Southern armyworm (SAW, *Spodoptera eridania*), Fall armyworm (FAW, *Spodoptera frugiperda*), Beet armyworm (BAW, *Spodoptera exigua*), Old World bollworm (OBW, *Helicoverpa armigera*), Oriental leafworm (OLW, *Spodoptera litura*), Pink bollworm (PBW, *Pectinophora gossypiella*), Southwestern Corn Borer (SWCB, *Diatraea grandiosella*), Spotted bollworm (SBW, *Earias vitella*), American bollworm (SABW, *Helicoverpa gelotopeon*), and Sunflower looper (SFL, *Rachiplusia nu*). Thus, the exemplary proteins described in this application are related by common function and exhibit insecticidal activity towards insect pests from the Lepidoptera insect species including adults, larvae and pupae.

Proteins that resemble the chimeric insecticidal proteins can be identified by comparison to each other using various computer based algorithms known in the art. For example, amino acid sequence identities of proteins related to the chimeric insecticidal proteins can be analyzed using a Clustal W alignment using these default parameters: Weight matrix: blosum, Gap opening penalty: 10.0, Gap extension penalty: 0.05, Hydrophilic gaps: On, Hydrophilic residues: GPSNDQERK, Residue-specific gap penalties: On (Thompson, et al (1994) Nucleic Acids Research, 22:4673-4680). Percent amino acid identity is further calculated by the product of 100% multiplied by (amino acid identities/length of the subject protein). Other alignment algorithms are also available in the art, provide results similar to those obtained using Clustal W alignment and are contemplated in this application.

It is intended that a query protein exhibiting insect inhibitory activity is disclosed in this application if alignment of such query protein with the subject chimeric insecticidal proteins set forth in SEQ ID NOs: 4, 7, 10, 13, 16, 19, 21, 23, 25, 28, 30, 33, 36, 39, 41, 43, 45, 47, 50, 53, 55, 57, 59, 61, 63, 65, 67, 69, 71, 73, 75, 77, 79, 81, 83, 85, 87, 89, 91, 93, 95, 97, 99, 101, 103, 105, 107, 109, and 111 and results in at least about 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100% amino acid sequence identity (or any fraction percentage in this range) between the query and subject protein. It is intended that a query protein exhibiting insect inhibitory activity is disclosed in this application if alignment of such query protein with the subject chimeric insecticidal proteins SEQ ID NO:93 and results in at least about 87%, 88%, 89%, 90%, 91%, 92%, 93%, 94%, 95%, 96%, 97%, 98%, 99%, or about 100% amino acid sequence identity (or any fraction percentage in this range) between the query and subject protein.

As described further in the Examples of this application, synthetic or artificial sequences encoding the chimeric insecticidal proteins were designed for use in plants. Exemplary synthetic nucleotide sequences that were designed for use in plants are set forth in SEQ ID NOs:2 and 3 (TIC1100), SEQ ID NO:6 (TIC860), SEQ ID NO:9 (TIC867), SEQ ID NO:12 (TIC867_20), SEQ ID NO:15 (TIC867_21), SEQ ID NO:18 (TIC867_22), SEQ ID NO:20 (TIC867_23), SEQ ID NO:22 (TIC867_24), SEQ ID NO:24 (TIC867_25), SEQ ID NO:27 (TIC868), SEQ ID NO:29 (TIC868_9), SEQ ID NO:32 (TIC868_10), SEQ ID NO:35 (TIC868_11), SEQ ID NO:38 (TIC868_12), SEQ ID NO:40 (TIC868_13), SEQ ID NO:42 (TIC868_14), SEQ ID NO:44 (TIC868_15), SEQ ID NO:46 (TIC868_29), SEQ ID NO:49 (TIC869) and SEQ ID NO:52 (TIC836), SEQ ID NO:112 and 113 (TIC713), SEQ ID NO:114 (TIC843), SEQ ID NO:115 (TIC862), SEQ ID NO:116 (TIC1099), SEQ ID NO:117 (TIC1103), SEQ ID NO:118 (TIC845), SEQ ID NO:119 (TIC846), SEQ ID NO:120 (TIC858), SEQ ID NO:121 (TIC866), SEQ ID NO:122 (TIC838), SEQ ID NO:123 (TIC841), SEQ ID NO:124 (TIC842), SEQ ID NO:125 (TIC850), SEQ ID NO:126 (TIC859), SEQ ID NO:127 (TIC861), SEQ ID NO:128 (TIC848), SEQ ID NO:129 (TIC849), and SEQ ID NO:130 (TIC847). An exemplary synthetic nucleotide sequence that was designed for use in plants is SEQ ID NO:122 (TIC838).

For expression in plant cells, the chimeric insecticidal proteins can be expressed to reside in the cytosol or targeted to various organelles of the plant cell. For example, targeting a protein to the chloroplast may result in increased levels of expressed protein in a transgenic plant while preventing off-phenotypes from occurring. Targeting may also result in an increase in pest resistance efficacy in the transgenic event. A target peptide or transit peptide is a short (3-70 amino acids long) peptide chain that directs the transport of a protein to a specific region in the cell, including the nucleus, mitochondria, endoplasmic reticulum (ER), chloroplast, apoplast, peroxisome and plasma membrane. Some target peptides are cleaved from the protein by signal peptidases after the proteins are transported. For targeting to the chloroplast, proteins contain transit peptides which are around 40-50 amino acids. For descriptions of the use of chloroplast transit peptides, see U.S. Pat. Nos. 5,188,642 and 5,728,925. Many chloroplast-localized proteins are expressed from nuclear genes as precursors and are targeted to the chloroplast by a chloroplast transit peptide (CTP). Examples of such isolated chloroplast proteins include, but are not limited to, those associated with the small subunit (SSU) of ribulose-1,5,-bisphosphate carboxylase, ferredoxin, ferredoxin oxidoreductase, the light-harvesting complex protein I and protein II, thioredoxin F, enolpyruvyl shikimate phosphate synthase (EPSPS), and transit peptides described in U.S. Pat. No. 7,193,133. It has been demonstrated in vivo and in vitro that non-chloroplast proteins may be targeted to the chloroplast by use of protein fusions with a heterologous CTP and that the CTP is sufficient to target a protein to the chloroplast. Incorporation of a suitable chloroplast transit peptide such as the *Arabidopsis thaliana* EPSPS CTP (CTP2) (see, Klee et al., *Mol. Gen. Genet.* 210:437-442, 1987) or the *Petunia hybrida* EPSPS CTP (CTP4) (see, della-Cioppa et al., *Proc. Natl. Acad. Sci. USA* 83:6873-6877, 1986) has been shown to target heterologous EPSPS protein sequences to chloroplasts in transgenic plants (see, U.S. Pat. Nos. 5,627,061; 5,633,435; and 5,312,910; and EP 0218571; EP 189707; EP 508909; and EP 924299). For targeting the chimeric insecticidal proteins to the chloroplast, a sequence encoding a chloroplast transit peptide is placed 5' in operable linkage and in frame to a synthetic coding sequence encoding the chimeric insecticidal protein that has been designed for optimal expression in plant cells.

Expression cassettes and vectors containing these synthetic or artificial nucleotide sequences were constructed and introduced into corn, cotton, and soybean plant cells in accordance with transformation methods and techniques which are known in the art. Transformed cells were regenerated into transformed plants that were observed to be expressing the chimeric insecticidal protein. To test pesticidal activity, bioassays were performed in the presence of Lepidopteran pest larvae using plant leaf disks obtained from the transformed plants. Recombinant nucleic acid molecule compositions that encode the chimeric insecticidal proteins are contemplated. For example, the chimeric insecticidal proteins can be expressed with recombinant DNA constructs in which a polynucleotide molecule with an ORF encoding a chimeric insecticidal protein is operably linked to genetic expression elements such as a promoter and any other regulatory element necessary for expression in the system for which the construct is intended. Non-limiting examples include a plant-functional promoter operably linked to the synthetic chimeric insecticidal protein encoding sequences for expression of the chimeric insecticidal protein in plants or a Bt-functional promoter operably linked to a chimeric insecticidal protein encoding sequence for expression of the protein in a Bt bacterium or other *Bacillus* species. Other elements can be operably linked to the chimeric insecticidal proteins encoding sequences including, but not limited to, enhancers, introns, untranslated leaders, encoded protein immobilization tags (HIS-tag), translocation peptides (i.e., plastid transit peptides, signal peptides), polypeptide sequences for post-translational modifying enzymes, ribosomal binding sites, and RNAi target sites.

Exemplary recombinant polynucleotide molecules provided herein include, but are not limited to, a heterologous promoter operably linked to a polynucleotide such as SEQ ID NOs: 1, 2, 3, 5, 6, 8, 9, 11, 12, 14, 15, 17, 18, 20, 22, 24, 26, 27, 29, 31, 32, 34, 35, 37, 38, 40, 42, 44, 46, 48, 49, 51, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 113, 114, 115, 116, 117, 118, 119, 120, 121, 122, 123, 124, 125, 126, 127, 128, 129, and 130; that encodes the polypeptide or protein having the amino acid sequence as set forth in SEQ ID NOs: 4 (TIC1100), 7 (TIC860), 10 (TIC867), 13 (TIC867_20), 16 (TIC867_21), 19 (TIC867_22), 21 (TIC867_23), 23 (TIC867_24), 25 (TIC867_25), 28 (TIC868), 30 (TIC868_9), 33 (TIC868_10), 36 (TIC868_11), 39 (TIC867_12), 41 (TIC867_13), 43 (TIC867_14), 45 (TIC867_15), 47 (TIC867_29), 50 (TIC869), 53 (TIC836), 55 (TIC713), 57 (TIC843), 59 (TIC862), 61 (TIC1099), 63 (TIC1099-T507E), 65 (TIC1099-R522K), 67 (TIC1099-K490S), 69 (TIC1099-T562R), 71 (TIC1099-S533R), 73 (TIC1099-G498D), 75 (TIC1099-K490A), 77 (TIC1099-E564A), 79 (TIC1103), 81 (TIC1101), 83 (TIC845), 85 (TIC846), 87 (TIC858), 89 (TIC865), 91 (TIC866), 93 (TIC838), 95 (TIC839), 97 (TIC841), 99 (TIC842), 101 (TIC850), 103 (TIC859), 105 (TIC861), 107 (TIC848), 109 (TIC849), and 111 (TIC847). Exemplary recombinant polynucleotide molecules provided herein include, but are not limited to, a heterologous promoter operably linked to a polynucleotide such as SEQ ID NOs:92 or 122, that encodes the polypeptide or protein having the amino acid sequence as set forth in SEQ ID NOs:93 (TIC838). A heterologous promoter can also be operably linked to synthetic DNA coding sequences encoding a plastid targeted chimeric insecticidal protein and untargeted chimeric insecticidal protein. It is contemplated that the codons of a recombinant nucleic acid molecule encoding for a chimeric insecticidal protein disclosed herein can be substituted by synonymous codons (known in the art as a silent substitution).

A recombinant DNA molecule or construct comprising a chimeric insecticidal protein encoding sequence can further comprise a region of DNA that encodes for one or more toxic agents which can be configured to concomitantly express or co-express with a DNA sequence encoding a chimeric insecticidal protein, a protein different from a chimeric insecticidal protein, an insect inhibitory dsRNA molecule, or an ancillary protein. Ancillary proteins include, but are not limited to, co-factors, enzymes, binding-partners, or other agents that function to aid in the effectiveness of an insect inhibitory agent, for example, by aiding its expression, influencing its stability in plants, optimizing free energy for oligomerization, augmenting its toxicity, and increasing its spectrum of activity. An ancillary protein may facilitate the uptake of one or more insect inhibitory agents, for example, or potentiate the toxic effects of the toxic agent.

A recombinant DNA molecule or construct can be assembled so that all proteins or dsRNA molecules are expressed from one promoter or each protein or dsRNA molecule is under separate promoter control or some combination thereof. The proteins of this invention can be expressed from a multi-gene expression system in which a chimeric insecticidal protein is expressed from a common nucleotide segment which also contains other open reading frames and promoters, depending on the type of expression system selected. For example, a bacterial multi-gene expression system can utilize a single promoter to drive expression of multiply-linked/tandem open reading frames from within a single operon (i.e., polycistronic expression). In another example, a plant multi-gene expression system can utilize multiply-unlinked expression cassettes, each expressing a different protein or other toxic agent such as one or more dsRNA molecules.

Recombinant nucleic acid molecules or recombinant DNA constructs comprising chimeric insecticidal protein encoding sequence can be delivered to host cells by vectors, e.g., a plasmid, baculovirus, synthetic chromosome, virion, cosmid, phagemid, phage, or viral vector. Such vectors can be used to achieve stable or transient expression of a chimeric insecticidal protein encoding sequence in a host cell, or subsequent expression of the encoded polypeptide. An exogenous recombinant polynucleotide or recombinant DNA construct that comprises chimeric insecticidal protein sequence encoding sequence and that is introduced into a host cell is referred herein as a "transgene".

Transgenic bacteria, transgenic plant cells, transgenic plants, and transgenic plant parts that contain a polynucleotide that encodes any one or more of the chimeric insecticidal proteins are provided herein. The term "bacterial cell" or "bacterium" can include, but is not limited to, an *Agrobacterium*, a *Bacillus*, an *Escherichia*, a *Salmonella*, a *Pseudomonas*, or a *Rhizobium* cell. The term "plant cell" or "plant" can include but is not limited to a dicotyledonous cell or a monocotyledonous cell. Contemplated plants and plant cells include, but are not limited to, alfalfa, banana, barley, bean, broccoli, cabbage, brassica, carrot, cassava, castor, cauliflower, celery, chickpea, Chinese cabbage, citrus, coconut, coffee, corn, clover, cotton, a cucurbit, cucumber, Douglas fir, eggplant, eucalyptus, flax, garlic, grape, hops, leek, lettuce, Loblolly pine, millets, melons, nut, oat, olive, onion, ornamental, palm, pasture grass, pea, peanut, pepper, pigeonpea, pine, potato, poplar, pumpkin, Radiata pine, radish, rapeseed, rice, rootstocks, rye, safflower, shrub, sorghum, Southern pine, soybean, spinach, squash, strawberry, sugar beet, sugarcane, sunflower, sweet corn, sweet gum, sweet potato, switchgrass, tea, tobacco, tomato, triticale, turf grass, watermelon, and wheat plant cell or plant. In certain embodiments, transgenic plants and transgenic plant parts regenerated from a transgenic plant cell are provided. In certain embodiments, the transgenic plants can be obtained from a transgenic seed, by cutting, snapping, grinding or otherwise disassociating the part from the plant. In certain embodiments, the plant part can be a seed, a boll, a leaf, a flower, a stem, a root, or any portion thereof, or a non-regenerable portion of a transgenic plant part. As used in this context, a "non-regenerable" portion of a transgenic plant part is a portion that cannot be induced to form a whole plant or that cannot be induced to form a whole plant that is capable of sexual and/or asexual reproduction. In certain embodiments, a non-regenerable portion of a plant part is a portion of a transgenic seed, boll, leaf, flower, stem, or root.

Methods of making transgenic plants that comprise Lepidoptera-inhibitory amounts of a chimeric insecticidal proteins are provided. Such plants can be made by introducing a polynucleotide that encodes the chimeric insecticidal proteins provided in this application into a plant cell, and selecting a plant derived from said plant cell that expresses an insect or Lepidoptera-inhibitory amount of the chimeric insecticidal protein. Plants can be derived from the plant cells by regeneration, seed, pollen, or meristem transformation techniques. Methods for transforming plants are known in the art. For example, *Agrobacterium*-mediated transformation is described in U.S. Patent Application Publications 2009/0138985A1 (soybean), 2008/0280361A1 (soybean), 2009/0142837A1 (corn), 2008/0282432 (cotton), and 2008/0256667 (cotton).

Plants expressing the chimeric insecticidal proteins can be crossed by breeding with transgenic events expressing other insecticidal proteins and/or expressing other transgenic traits such as other insect control traits, herbicide tolerance genes, genes conferring yield or stress tolerance traits, and the like, or such traits can be combined in a single vector so that the traits are all linked.

Processed plant products, wherein the processed product comprises a detectable amount of a chimeric insecticidal protein, an insect inhibitory segment or fragment thereof, or any distinguishing portion thereof, are also disclosed in this application. In certain embodiments, the processed product is selected from the group consisting of plant parts, plant biomass, oil, meal, sugar, animal feed, flour, flakes, bran, lint, hulls, processed seed, and seed. In certain embodiments, the processed product is non-regenerable. The plant product can comprise commodity or other products of commerce derived from a transgenic plant or transgenic plant part, where the commodity or other products can be tracked through commerce by detecting nucleotide segments or expressed RNA or proteins that encode or comprise distinguishing portions of a chimeric insecticidal protein.

Methods of controlling insects, in particular Lepidoptera infestations of crop plants, with the chimeric insecticidal proteins are also disclosed in this application. Such methods can comprise growing a plant comprising an insect- or Lepidoptera-inhibitory amount of the chimeric insecticidal protein. In certain embodiments, such methods can further comprise any one or more of: (i) applying any composition comprising or encoding a chimeric insecticidal protein to a plant or a seed that gives rise to a plant; and (ii) transforming a plant or a plant cell that gives rise to a plant with a polynucleotide encoding a chimeric insecticidal protein. In general, it is contemplated that chimeric insecticidal protein can be provided in a composition, provided in a microorganism, or provided in a transgenic plant to confer insect inhibitory activity against Lepidopteran insects.

In certain embodiments, the chimeric insecticidal protein is the insecticidally active ingredient of an insect inhibitory composition prepared by culturing recombinant *Bacillus* or any other recombinant bacterial cell transformed to express a chimeric insecticidal protein under conditions suitable for expression. Such a composition can be prepared by desiccation, lyophilization, homogenization, extraction, filtration, centrifugation, sedimentation, or concentration of a culture of such recombinant cells expressing/producing the chimeric insecticidal protein. Such a process can result in a *Bacillus* or other entomopathogenic bacterial cell extract, cell suspension, cell homogenate, cell lysate, cell supernatant, cell filtrate, or cell pellet. By obtaining the chimeric insecticidal protein so produced, a composition that includes the chimeric insecticidal protein can include bacterial cells, bacterial spores, and parasporal inclusion bodies and can be formulated for various uses, including as agricultural insect inhibitory spray products or as insect inhibitory formulations in diet bioassays.

The aforementioned compound or formulation can further comprise an agriculturally-acceptable carrier, such as a bait, a powder, dust, pellet, granule, spray, emulsion, a colloidal suspension, an aqueous solution, a *Bacillus* spore or crystal preparation or a seed treatment. The compound or formulation can also further comprise a recombinant plant cell, plant tissue, seed or plant transformed to express one or more of the proteins; or bacterium transformed to express one or more of the proteins. Depending on the level of insect inhibitory or insecticidal inhibition inherent in the recombinant polypeptide and the level of compound or formulation to be applied to a plant or diet assay, the compound or formulation can include various by weight amounts of the recombinant polypeptide, e.g. from 0.0001% to 0.001% to 0.01% to 1% to 99% by weight of the recombinant polypeptide.

In an embodiment, in order to reduce the likelihood of resistance development, an insect inhibitory composition or transgenic plant comprising a chimeric insecticidal protein can further comprise at least one additional toxic agent that exhibits insect inhibitory activity against the same Lepidopteran insect species, but which is different from the chimeric insecticidal protein. Possible additional toxic agents for such a composition include an insect inhibitory protein and an insect inhibitory dsRNA molecule. One example for the use of such ribonucleotide sequences to control insect pests is described in Baum, et al. (U.S. Patent Publication 2006/0021087 A1). Such additional polypeptide(s) for the control of Lepidopteran pests may be selected from the group consisting of an insect inhibitory protein, such as, but not limited to, Cry1A (U.S. Pat. No. 5,880,275), Cry1Ab, Cry1Ac, Cry1A.105, Cry1Ae, Cry1B (U.S. patent Publication Ser. No. 10/525,318), Cry1C (U.S. Pat. No. 6,033,874), Cry1D, Cry1E, Cry1F, and Cry1A/F chimeras (U.S. Pat. Nos. 7,070,982; 6,962,705; and 6,713,063), Cry1G, Cry1H, Cry1I, Cry1J, Cry1K, Cry1L, Cry2A, Cry2Ab (U.S. Pat. No. 7,064,249), Cry2Ae, Cry4B, Cry6, Cry7, Cry8, Cry9, Cry15, Cry43A, Cry43B, Cry51Aa1, ET66, TIC400, TIC800, TIC834, TIC1415, Vip3A, VIP3Ab, VIP3B, AXMI-001, AXMI-002, AXMI-030, AXMI-035, AND AXMI-045 (U.S. Patent Publication 2013-0117884 A1), AXMI-52, AXMI-58, AXMI-88, AXMI-97, AXMI-102, AXMI-112, AXMI-117, AXMI-100 (U.S. Patent Publication 2013-0310543 A1), AXMI-115, AXMI-113, AXMI-005 (U.S. Patent Publication 2013-0104259 A1), AXMI-134 (U.S. Patent Publication 2013-0167264 A1), AXMI-150 (U.S. Patent Publication 2010-0160231 A1), AXMI-184 (U.S. Patent Publication 2010-0004176 A1), AXMI-196, AXMI-204, AXMI-207, AXMI-209 (U.S. Patent Publication 2011-0030096 A1), AXMI-218, AXMI-220 (U.S. Patent Publication 2014-0245491 A1), AXMI-221z, AXMI-222z, AXMI-223z, AXMI-224z, AXMI-225z (U.S. Patent Publication 2014-0196175 A1), AXMI-238 (U.S. Patent Publication 2014-0033363 A1), AXMI-270 (U.S. Patent Publication 2014-0223598 A1), AXMI-345 (U.S. Patent Publication 2014-0373195 A1), DIG-3 (U.S. Patent Publication 2013-0219570 A1), DIG-5 (U.S. Patent Publication 2010-0317569 A1), DIG-11 (U.S. Patent Publication 2010-0319093 A1), AfIP-1A and derivatives thereof (U.S. Patent Publication 2014-0033361 A1), AfIP-1B and derivatives thereof (U.S. Patent Publication 2014-0033361 A1), PIP-1APIP-1B (U.S. Patent Publication 2014-0007292 A1), PSEEN3174 (U.S. Patent Publication 2014-0007292 A1), AECFG-592740 (U.S. Patent Publication 2014-0007292 A1), Pput_1063 (U.S. Patent Publication 2014-0007292 A1), Pput_1064 (U.S. Patent Publication 2014-0007292 A1), GS-135 and derivatives thereof (U.S. Patent Publication 2012-0233726 A1), GS153 and derivatives thereof (U.S. Patent Publication 2012-0192310 A1), GS154 and derivatives thereof (U.S. Patent Publication 2012-0192310 A1), GS155 and derivatives thereof (U.S. Patent Publication 2012-0192310 A1), SEQ ID NO:2 and derivatives thereof as described in U.S. Patent Publication 2012-0167259 A1, SEQ ID NO:2 and derivatives thereof as described in U.S. Patent Publication 2012-0047606 A1, SEQ ID NO:2 and derivatives thereof as described in U.S. Patent Publication 2011-0154536 A1, SEQ ID NO:2 and derivatives thereof as described in U.S. Patent Publication 2011-0112013 A1, SEQ ID NO:2 and 4 and derivatives thereof as described in U.S. Patent Publication 2010-0192256 A1, SEQ ID NO:2 and derivatives thereof as described in U.S. Patent Publication 2010-0077507 A1, SEQ ID NO:2 and derivatives thereof as described in U.S. Patent Publication 2010-0077508 A1, SEQ ID NO:2 and derivatives thereof as described in U.S. Patent Publication 2009-0313721 A1, SEQ ID NO:2 or 4 and derivatives thereof as described in U.S. Patent Publication 2010-0269221 A1, SEQ ID NO:2 and derivatives thereof as described in U.S. Pat. No. 7,772,465 (B2), CF161_0085 and derivatives thereof as described in WO2014/008054 A2, Lepidopteran toxic proteins and their derivatives as described in US Patent Publications US2008-0172762 A1, US2011-0055968 A1, and US2012-0117690 A1; SEQ ID NO:2 and derivatives thereof as described in US7510878 (B2), SEQ ID NO:2 and derivatives thereof as described in U.S. Pat. No. 7,812,129(B1); and the like.

In other embodiments, an insect inhibitory composition or transgenic plant can further comprise at least one additional toxic agent that exhibits insect inhibitory activity to an insect pest that is not inhibited by the chimeric insecticidal proteins of the present invention (such as Coleopteran, Hemipteran and Homopteran pests), in order to expand the spectrum of insect inhibition obtained.

Such additional toxic agent for the control of Coleopteran pests may be selected from the group consisting of an insect inhibitory protein, such as, but not limited to, Cry3Bb (U.S. Pat. No. 6,501,009), Cry1C variants, Cry3A variants, Cry3, Cry3B, Cry34/35, 5307, AXMI134 (U.S. Patent Publication 2013-0167264 A1) AXMI-184 (U.S. Patent Publication 2010-0004176 A1), AXMI-205 (U.S. Patent Publication 2014-0298538 A1), axmi207 (U.S. Patent Publication 2013-0303440 A1), AXMI-218, AXMI-220 (U.S. Patent Publication 20140245491A1), AXMI-221z, AXMI-223z (U.S. Patent Publication 2014-0196175 A1), AXMI-279 (U.S. Patent Publication 2014-0223599 A1), AXMI-R1 and variants thereof (U.S. Patent Publication 2010-0197592 A1, TIC407, TIC417, TIC431, TIC807, TIC853, TIC901, TIC1201, TIC3131, DIG-10 (U.S. Patent Publication 2010-0319092 A1), eHIPs (U.S. Patent Application Publication No. 2010/0017914), IP3 and variants thereof (U.S. Patent Publication 2012-0210462 A1), and ω-Hexatoxin-Hv1a (U.S. Patent Application Publication US2014-0366227 A1).

Such additional toxic agent for the control of Hemipteran pests may be selected from the group consisting of Hemipteran-active proteins such as, but not limited to, TIC1415 (US Patent Publication 2013-0097735 A1), TIC807 (U.S. Pat. No. 8,609,936), TIC834 (U.S. Patent Publication 2013-0269060 A1), AXMI-036 (U.S. Patent Publication 2010-0137216 A1), and AXMI-171 (U.S. Patent Publication 2013-0055469 A1). Additional polypeptides for the control of Coleopteran, Lepidopteran, and Hemipteran insect pests can be found on the *Bacillus thuringiensis* toxin nomenclature website maintained by Neil Crickmore (on the world wide web at btnomenclature.info).

Chimeric insecticidal protein-encoding sequences and sequences having a substantial percentage identity to the chimeric insecticidal proteins can be identified using methods known to those of ordinary skill in the art such as polymerase chain reaction (PCR), thermal amplification and hybridization. For example, the chimeric insecticidal proteins can be used to produce antibodies that bind specifically to related proteins, and can be used to screen for and to find other proteins that are closely related.

Furthermore, nucleotide sequences encoding the chimeric insecticidal proteins can be used as probes and primers for screening to identify other members of the class using thermal-cycle or isothermal amplification and hybridization methods. For example, oligonucleotides derived from sequences as set forth in SEQ ID NO:2 can be used to determine the presence or absence of a chimeric insecticidal transgene in a deoxyribonucleic acid sample derived from a commodity product. Given the sensitivity of certain nucleic acid detection methods that employ oligonucleotides, it is anticipated that oligonucleotides derived from sequences as set forth in any of SEQ ID NO:2 can be used to detect the respective chimeric insecticidal protein in commodity products derived from pooled sources where only a fraction of the commodity product is derived from a transgenic plant containing any of SEQ ID NO:2.

Furthermore, nucleotide sequences encoding the chimeric insecticidal proteins can be used as probes and primers for screening to identify other members of the class using thermal-cycle or isothermal amplification and hybridization methods. For example, oligonucleotides derived from sequences as set forth in SEQ ID NO:122 can be used to determine the presence or absence of a chimeric insecticidal transgene in a deoxyribonucleic acid sample derived from a commodity product. Given the sensitivity of certain nucleic acid detection methods that employ oligonucleotides, it is anticipated that oligonucleotides derived from sequences as set forth in any of SEQ ID NO:122 can be used to detect the respective chimeric insecticidal protein in commodity products derived from pooled sources where only a fraction of the commodity product is derived from a transgenic plant containing any of SEQ ID NO:122.

EXAMPLES

In view of the foregoing, those of skill in the art will appreciate that the following disclosed embodiments are merely representative of the invention, which may be embodied in various forms. Thus, specific structural and functional details disclosed herein are not to be interpreted as limiting.

Example 1

Creation and Cloning of Lepidopteran-Active Novel Chimeric Insecticidal Protein Coding Sequences This Example illustrates the creation of the novel chimeric insecticidal proteins and the cloning and expressing of the chimeric insecticidal proteins.

Recombinant nucleic acid sequences were constructed from known Cry protein genes to produce polynucleotide sequences encoding novel chimeric insecticidal proteins. The resulting polynucleotide sequences were cloned into a *Bacillus thuringiensis* (Bt) expression plasmid vector. After confirmation of the polynucleotide sequence, the expression plasmid was transformed into Bt and expressed. Preparations of the expressed novel chimeric proteins were assayed for activity against various Lepidopteran pests.

Many polynucleotide sequences encoding chimeric insecticidal proteins were produced and tested in bioassay. Not all of the chimeric insecticidal proteins demonstrated activity. Only a few of the chimeric insecticidal proteins were selected based upon their activity to specific Lepidoptera demonstrated in bioassay such as TIC838 (SEQ ID NO:93). Amino acid variants in which amino acid substitutions, or alternate protoxin domains, were introduced were also produced based upon the original chimeric insecticidal proteins TIC867 and TIC868. The components of the chimeric insecticidal proteins (domains I, II and III and the protoxin) of the present invention are presented in Table 1. The amino acid substitutions in the TIC868 variants relative to the original TIC868 protein sequence are also presented.

TABLE 1

Novel chimeric pesticidal proteins and their components.

| Toxin | PRT SEQ ID NO: | Dom1 | Dom2 | Dom3 | Protox | Amino Acid Modifications* |
|---|---|---|---|---|---|---|
| TIC1100 | 4 | CrY1Ah | Cry1Ac | Cry1Ca | Cry1Ac | |
| TIC860 | 7 | Cry1Bb1 | Cry1Bb1 | Cry1Ca | Cry1Ac | |

TABLE 1-continued

Novel chimeric pesticidal proteins and their components.

| Toxin | PRT SEQ ID NO: | Dom1 | Dom2 | Dom3 | Protox | Amino Acid Modifications* |
|---|---|---|---|---|---|---|
| TIC867 | 10 | Cry1Be2 | Cry1Be2 | Cry1Ka | Cry1Ab3 | |
| TIC867_20 | 13 | Cry1Be2 | Cry1Be2 | Cry1Ka | Cry1Da1 | |
| TIC867_21 | 16 | Cry1Be2 | Cry1Be2 | Cry1Ka | Cry4 | |
| TIC867_22 | 19 | Cry1Be2 | Cry1Be2 | Cry1Ka | Cry9 | |
| TIC867_23 | 21 | Cry1Be2 | Cry1Be2 | Cry1Ka | Cry1Be | |
| TIC867_24 | 23 | Cry1Be2 | Cry1Be2 | Cry1Ka | Cry1Ka | |
| TIC867_25 | 25 | Cry1Be2 | Cry1Be2 | Cry1Ka | Cry1Ca | |
| TIC868 | 28 | Cry1Be2 | Cry1Be2 | Cry1Ca | Cry1Ab3 | |
| TIC868_9 | 30 | Cry1Be2 | Cry1Be2 | Cry1Ca | Cry1Ab3 | N240S_Y343Q_N349T |
| TIC868_10 | 33 | Cry1Be2 | Cry1Be2 | Cry1Ca | Cry1Da1 | |
| TIC868_11 | 36 | Cry1Be2 | Cry1Be2 | Cry1Ca | Cry4 | |
| TIC868_12 | 39 | Cry1Be2 | Cry1Be2 | Cry1Ca | Cry9 | |
| TIC868_13 | 41 | Cry1Be2 | Cry1Be2 | Cry1Ca | Cry1Be | |
| TIC868_14 | 43 | Cry1Be2 | Cry1Be2 | Cry1Ca | Cry1Ka | |
| TIC868_15 | 45 | Cry1Be2 | Cry1Be2 | Cry1Ca | Cry1Ca | |
| TIC868_29 | 47 | Cry1Be2 | Cry1Be2 | Cry1Ca | Cry1Ab3 | Q136Y_Y343Q_N349T |
| TIC869 | 50 | Cry1Ja1 | Cry1Ja1 | Cry1Jx | Cry1Ab3 | |
| TIC836 | 53 | Cry1Fa1 | Cry1Fa1 | Cry1Ab | Cry1Ac | |
| TIC838 | 93 | Cry1Ca | Cry1Cb | Cry1Ac | Cry1Ac | |

*The amino acid mutations are identified using the standard IUPAC amino acid code. See IUPAC-IUB Joint Commission on Biochemical Nomenclature. Nomenclature and Symbolism for Amino Acids and Peptides. Eur. J. Biochem. 138: 9-37(1984). The first amino acid sequence abbreviation indicates the original amino acid in the given scaffold protein, the number represents the position of the amino acid, and the second amino acid sequence abbreviation indicates the amino acid placed in that position in the improved variant protein.

Example 2

The Novel Chimeric Insecticidal Proteins Demonstrate Activity Against Lepidopteran Pests This Example illustrates the testing of the chimeric insecticidal proteins described in Example 1 and the Lepidopteran activity observed for the chimeric insecticidal proteins.

Polynucleotide sequences encoding chimeric insecticidal proteins were expressed in Bt. The expressed chimeric insecticidal proteins were then assayed against a variety of Lepidoptera known to be pests of corn, sugarcane, soybean and cotton, as well as other crop plants. Specifically, the insecticidal proteins were assayed for activity against Velvetbean caterpillar (VBC, *Anticarsia gemmatalis*), Sugarcane borer (SCB, *Diatraea saccharalis*), Lesser cornstalk borer (LSCB, *Elasmopalpus lignosellus*), Corn earworm (CEW, *Helicoverpa zea*), Tobacco budworm (TBW, *Heliothis virescens*), Soybean looper (SBL, *Chrysodeixis includens*), Black armyworm (BLAW, *Spodoptera cosmioides*), Southern armyworm (SAW, *Spodoptera eridania*), Fall armyworm (FAW, *Spodoptera frugiperda*), Beet armyworm (BAW, *Spodoptera exigua*), Old World bollworm (OBW, *Helicoverpa armigera*), Oriental leafworm (OLW, *Spodoptera litura*), Pink bollworm (PBW, *Pectinophora gossypiella*), Black cutworm (BCW, *Agrotis ipsilon*), Southwestern Corn Borer (SWCB, *Diatraea grandiosella*), Spotted bollworm (SBW, *Earias vitella*), and European corn borer (ECB, *Ostrinia nubilalis*). Corn earworm (CEW, *Helicoverpa zea*) is also referred to as Soybean pod worm (SPW) and Cotton bollworm (CBW). Activity was determined through a combination of mortality and stunting scores as well as MIC50 scores. MIC50 refers to a molt inhibition concentration wherein both the dead larvae and L1 larvae (larvae that failed to molt to second instars) are factored into the score. Table 2 shows the activity of each chimeric insecticidal protein. A '+' sign indicates activity observed to the specific insect pest.

TABLE 2

Bioassay activity against selected *Lepidoptera*.

| Toxin | PRT SEQ ID NO: | Insect | | | | | | | | | | | | | | | |
|---|---|---|---|---|---|---|---|---|---|---|---|---|---|---|---|---|---|
| | | VBC | SCB | LSCB | CEW SPW CBW | BLAW | TBW | SBL | SAW | FAW | BAW | OBW | OLW | PBW | BCW | SWCB | ECB | SBW |
| TIC1100 | 4 | + | + | | | + | | + | | + | | + | + | | | | | |
| TIC860 | 7 | + | + | + | | + | + | + | + | + | + | | + | + | | + | | + |
| TIC867 | 10 | + | + | | | + | | + | | + | + | + | + | | | + | | |
| TIC867_20 | 13 | | | | | | | | | | | | | | | | | |
| TIC867_21 | 16 | | | | + | | | | | | | | | | | | | |
| TIC867_22 | 19 | | | | + | | | | | + | | | | | | | | |
| TIC868 | 28 | + | + | | | + | | + | | + | + | | + | + | | + | | + |
| TIC868_10 | 33 | | | | | | | | | + | | | | | | | | |
| TIC868_11 | 36 | | | | | | | | | + | | | | | | | | |
| TIC868_12 | 39 | | | | | | | | | + | | | | | | | | |
| TIC869 | 50 | + | + | | | | + | | + | | | | | | | + | | |

TABLE 2-continued

Bioassay activity against selected *Lepidoptera*.

| Toxin | PRT SEQ ID NO: | VBC | SCB | LSCB | CEW SPW CBW | BLAW | TBW | SBL | SAW | FAW | BAW | OBW | OLW | PBW | BCW | SWCB | ECB | SBW |
|---|---|---|---|---|---|---|---|---|---|---|---|---|---|---|---|---|---|---|
| TIC836 | 53 | + | | | + | | + | + | + | | | | | | | | | |
| TIC838 | 93 | + | + | | | + | + | + | + | + | | | | | | + | | |

As can be seen in Table 2 above, most of the chimeric insecticidal proteins exhibited activity against one or more Lepidopteran pest species.

Example 3

Synthesis of Genes Encoding Chimeric Insecticidal Proteins and for Expression in Plants This Example illustrates the synthesis of polynucleotides encoding the chimeric insecticidal proteins for expression in plants.

Synthetic coding sequences were constructed for use in expression of the chimeric insecticidal proteins in plants. The synthetic sequences were designed and synthesized according to methods generally described in U.S. Pat. No. 5,500,365, avoiding certain inimical problem sequences such as ATTTA and A/T rich plant polyadenylation sequences while preserving the amino acid sequence of the chimeric insecticidal protein. The nucleotide sequences for these genes encoding the chimeric insecticidal proteins for expression in plants are listed in Table 3. The nucleotide sequence for the gene encoding the TIC838 chimeric insecticidal protein for expression in plants is presented as SEQ ID NO:3

TABLE 3

Polynucleotide Sequences Encoding Chimeric Insecticidal Proteins Designed for Use in Plants.

| Insecticidal Protein | DNA SEQ ID NO: | PRT SEQ ID NO: |
|---|---|---|
| TIC1100 | 2 | 4 |
| TIC1100 | 3 | 4 |
| TIC860 | 6 | 7 |
| TIC867 | 9 | 10 |
| TIC867_20 | 12 | 13 |
| TIC867_21 | 15 | 16 |
| TIC867_22 | 18 | 19 |
| TIC867_23 | 20 | 21 |
| TIC867_24 | 22 | 23 |
| TIC867_25 | 24 | 25 |
| TIC868 | 27 | 28 |
| TIC868_9 | 29 | 30 |
| TIC868_10 | 32 | 33 |
| TIC868_11 | 35 | 36 |
| TIC868_12 | 38 | 39 |
| TIC868_13 | 40 | 41 |
| TIC868_14 | 42 | 43 |
| TIC868_15 | 44 | 45 |
| TIC868_29 | 46 | 47 |
| TIC869 | 49 | 50 |
| TIC836 | 52 | 53 |
| TIC838 | 122 | 93 |

Example 4

Expression Cassettes for the Expression of Chimeric Insecticidal Proteins in Plants This Example illustrates the construction of expression cassettes comprising polynucleotide sequences designed for use in plants which encode chimeric insecticidal proteins.

A variety of plant expression cassettes were constructed with the polynucleotide sequences encoding the chimeric insecticidal proteins designed for plant expression provided in Table 3. Such expression cassettes are useful for transient expression in plant protoplasts or transformation of plant cells. Typical expression cassettes were designed with respect to the eventual placement of the protein within the cell. One set of expression cassettes was designed in a manner to allow the protein to be translated and remain in the cytosol. Another set of expression cassettes was designed to have a transit peptide contiguous with the toxin protein to allow targeting to an organelle of the cell such as the chloroplast or plastid. All expression cassettes were designed to begin at the 5' end with a promoter, which can be comprised of multiple promoter elements, enhancer elements, or other expression elements known to those of ordinary skill in the art operably linked to boost the expression of the transgene. The promoter sequence was usually followed contiguously with one or more leader sequences 3' to the promoter. An intron sequence was usually provided 3' to the leader sequence to improve expression of the transgene. A coding sequence for the toxin or transit peptide and coding sequence for the toxin was usually located 3' to the operably linked promoter, leader and intron configuration. A 3'UTR sequence was usually provided 3' of the coding sequence to facilitate termination of transcription and to provide sequences important for the polyadenylation of the resulting transcript. All of the elements described above were operably linked and arranged sequentially, often with additional sequences provided for the construction of the expression cassette.

The binary transformation vector typically is comprised of T-DNA consisting of two transgene cassettes; one for the selection of transformed plant cells using a selectable marker such as glyphosate or an antibiotic such as spectinomycin. The T-DNA is flanked by a right and left border sequence derived from *Agrobacterium tumefaciens* used for stable integration of the T-DNA into the plant host chromosomal DNA.

Example 5

Lepidopteran Activity of the Chimeric Insecticidal Proteins in Stably Transformed Corn This Example illustrates the inhibitory activity exhibited by the chimeric insecticidal proteins against Lepidopteran pests when expressed in corn plants and provided as a diet to the respective corn insect pest.

Corn variety LH244 was transformed with the binary transformation vectors described in Example 4 using an *Agrobacterium*-mediated transformation method. The transformed cells were induced to form plants by methods known in the art. Bioassays using plant leaf disks were performed analogous to those described in U.S. Pat. No. 8,344,207. A non-transformed LH244 plant was used to obtain tissue to be used as a negative control. Multiple transformation events from each binary vector were assessed against Corn earworm (CEW, *Helicoverpa zea*), Fall armyworm (FAW, *Spodoptera frugiperda*), Black cutworm (BCW, *Agrotis ipsilon*) and Southwestern Corn Borer (SWCB, *Diatraea grandiosella*).

Leaf disc bioassay was performed on $R_0$ and $F_1$ generation transgenic plants. In addition, leaf damage ratings were assessed for whole transgenic $F_1$ plants expressing certain chimeric insecticidal proteins infested with the Lepidopteran insect pests. $F_1$ transgenic events expressing TIC860 and TIC868 were also assessed for activity in the field against FAW, CEW, and SWCB. The assay results are shown in Table 4. A '+' sign indicates activity observed to the specific insect pest. As can be seen in Table 4, most of the chimeric insecticidal proteins and many of the chimeric insecticidal protein variants demonstrated activity against one or more Lepidopteran pest species.

for expression of the chimeric insecticidal protein as described in Example 4 and a second transgene cassette for the selection of transformed plant cells using spectinomycin selection. In some instances, such as in the case of TIC1100, TIC860 and TIC836, a chloroplast transit peptide coding sequence was operably linked to the chimeric insecticidal coding sequence. Assays were performed with plastid targeted and untargeted TIC1100, TIC860 and TIC836. Table 5 below shows the chimeric insecticidal and TIC867 variant chimeric insecticidal protein and associated coding sequences used for expression in stably transformed soybean.

Soybean plant cells were transformed using the binary transformation vectors described above by *Agrobacterium*-mediated transformation. The resulting transformed plant cells were induced to form whole soybean plants. Leaf tissue was harvested and used in bioassay as described in Example 5 or alternatively, lyophilized tissue was used in the insect diet for bioassay. Bioassay was performed against Fall armyworm (FAW, *Spodoptera frugiperda*), Southern armyworm (SAW, *Spodoptera eridania*), Soybean looper (SBL,

TABLE 4

Bioassay activity of chimeric insecticidal proteins from stably transformed corn leaf tissue.

| Toxin | PRT SEQ ID NO: | VBC | SCB | LSCB | CEW SPW CBW | BLAW | TBW | SBL | SAW | FAW | BAW | OBW | OLW | PBW | BCW | SWCB | ECB | SBW |
|---|---|---|---|---|---|---|---|---|---|---|---|---|---|---|---|---|---|---|
| TIC1100 | 4 | + | + | | | + | | | + | | + | | | + | + | | | | |
| TIC860 | 7 | + | + | + | | + | + | + | + | + | + | | + | + | | + | | + |
| TIC867 | 10 | + | + | | | + | | + | | + | + | + | + | | | + | | |
| TIC867_20 | 13 | NT | NT | NT | | NT | NT | NT | NT | | NT | NT | NT | NT | NT | NT | NT | NT |
| TIC867_21 | 16 | NT | NT | NT | + | NT | NT | NT | NT | | NT | NT | NT | NT | NT | NT | NT | NT |
| TIC867_22 | 19 | NT | NT | NT | + | NT | NT | NT | NT | + | NT | NT | NT | NT | NT | NT | NT | NT |
| TIC868 | 28 | + | + | | | + | | + | + | + | + | | + | + | | + | | + |
| TIC868_10 | 33 | NT | NT | NT | + | NT | NT | NT | NT | + | NT | NT | NT | NT | NT | NT | NT | NT |
| TIC868_11 | 36 | NT | NT | NT | + | NT | NT | NT | NT | + | NT | NT | NT | NT | NT | NT | NT | NT |
| TIC868_12 | 39 | NT | NT | NT | + | NT | NT | NT | NT | + | NT | NT | NT | NT | NT | NT | NT | NT |
| TIC869 | 50 | + | + | | | | | | + | + | + | | | | | + | | |
| TIC836 | 53 | + | | | | + | | + | + | + | | | | | | | | |

Example 6

Lepidopteran Activity of the Chimeric Insecticidal Proteins in Stably Transformed Soybean This Example illustrates the inhibitory activity exhibited by the chimeric insecticidal proteins against Lepidopteran pests when expressed in soybean plants and provided as a diet to the respective insect pest.

The coding sequences for selected chimeric insecticidal proteins were redesigned for plant expression, cloned into a binary plant transformation vector, and used to transform soybean plant cells using methods known in the art. Tissues are harvested from the transformants and used in insect bioassay against various Lepidopteran insects. The plant transformation vectors comprised a first transgene cassette

*Chrysodeixis includens*), Soybean Pod Worm (SPW, *Helicoverpa zea*), Velvetbean caterpillar (VBC, *Anticarsia gemmatalis*), Tobacco budworm (TBW, *Heliothis virescens*), Black armyworm (BLAW, *Spodoptera cosmioides*), Lesser cornstalk borer (LSCB, *Elasmopalpus lignosellus*) and Old World bollworm (OBW, *Helicoverpa armigera*).

Table 5 shows the activity against selected species of Lepidoptera for each insecticidal protein in $R_0$ generation plants, wherein '+' indicates activity. As can be seen in Table 5, each of the chimeric insecticidal proteins expressed in stably transformed soybean demonstrated activity against multiple Lepidopteran species. Of particular note is that the TIC867 variant, TIC867_23 demonstrated activity against SPW.

TABLE 5

Bioassay activity of chimeric insecticidal proteins from stably transformed R₀ soybean leaf tissue.

| Insecticidal Protein | FAW | SAW | SBL | SPW | VBC | TBW | BLAW | LSCB | OBW |
|---|---|---|---|---|---|---|---|---|---|
| TIC1100 | + | + | + |   | + |   | + | + | + |
| TIC860 | + | + | + |   | + |   |   | + |   |
| TIC867 | + | + | + |   | + | + |   | + |   |
| TIC867_20 |   | + | + |   |   |   |   |   |   |
| TIC867_21 |   | + | + |   |   |   |   |   |   |
| TIC867_22 |   | + | + |   |   |   |   |   |   |
| TIC867_23 | + | + | + | + |   |   |   |   |   |
| TIC867_24 |   | + | + |   |   |   |   |   |   |
| TIC867_25 |   | + | + |   |   |   |   |   |   |
| TIC868 | + |   | + |   | + |   | + | + |   |
| TIC869 |   |   | + |   | + | + |   | + |   |
| TIC836 | + | + | + |   | + | + | + |   | + |

Selected transformed events were allowed to self-pollinate and the resulting seed was grown. Leaf tissue was harvested from the R₁ generation plants and used in a feeding bioassay. R₁ plants expressing TIC1100, TIC860, TIC867, TIC868, TIC869 and TIC836 were assayed for activity against SAW, SBL, SPW and VBC. Table 6 shows the activity observed in these tests. A '+' sign indicates activity observed to the specific insect pest. As demonstrated in Table 6, most of the expressed chimeric insecticidal proteins from R₁ generation plants demonstrated activity to one or more Lepidopteran species.

TABLE 6

Bioassay activity of chimeric insecticidal proteins from stably transformed R₁ soybean leaf tissue.

| Toxin | SAW | SBL | SPW | VBC |
|---|---|---|---|---|
| TIC1100 | + | + |   | + |
| TIC860 | + | + |   | + |
| TIC867 | + |   |   |   |
| TIC868 | + | + |   | + |
| TIC869 | + | + |   | + |
| TIC836 | + | + |   | + |

Table 7 demonstrates the results of field tests conducted in screen houses with stably transformed R₁ generation soybean plants expressing TIC1100, TIC860, and TIC836. Species used to infest plants in the screen houses include SAW, SBL and SPW. Resistance was defined as being less than or equal to fifteen percent defoliation in the soybean plants. The resistance observed in these cage trials is consistent with the resistance observed in the R₁ generation soybean leaf tissue assay presented in Table 6. A '+' sign indicates activity observed to the specific insect pest.

TABLE 7

Activity Profile of TIC1100, TIC860 and TIC836 Expressed in R₁ Generation Soybean Tested in Screen House Field Tests.

| Toxin | SAW | SBL | SPW |
|---|---|---|---|
| TIC1100 | + | + |   |
| TIC860 | + | + |   |
| TIC836 | + | + |   |

Field tests in screen houses with stably transformed R₁ generation soybean plants expressing TIC867 and TIC869 were also conducted at two different locations in Argentina, Acevedo and Fontezuela. Species used to infest plants in the screen houses include South American bollworm (SABW, *Helicoverpa gelotopeon*), VBC, BLAW, and Sunflower looper (SFL, *Rachiplusia nu*). Resistance was defined as being less than or equal to fifteen percent defoliation in the soybean plants. Table 8 below shows the resistance observed. A '+' sign indicates activity observed to the specific insect pest. As demonstrated in Table 8, transgenic soybean plants expressing TIC867 demonstrated resistance to BLAW and VBC. Transgenic soybean plants expressing TIC869 demonstrated resistance to SABW, SFL, BLAW, and VBC.

TABLE 8

Activity Profile of TIC867 and TIC869 Expressed in R₁ Generation Soybean Tested in Screen House Field Tests.

| | Acevedo | | | Fontezuela | | |
|---|---|---|---|---|---|---|
| Toxin | SABW | SFL | VBC | SABW | BLAW | VBC |
| TIC867 |   | + |   |   | + | + |
| TIC869 | + | + | + | + | + | + |

Example 7

Lepidopteran Activity of the Chimeric Insecticidal Proteins in Stably Transformed Cotton This Example illustrates the inhibitory activity exhibited by the chimeric insecticidal proteins against Lepidopteran pests when expressed in cotton plants and provided as a diet to the respective insect pest.

The coding sequences for selected chimeric insecticidal proteins were redesigned for plant expression, cloned into a binary plant transformation vector, and used to transform cotton plant cells using methods known in the art. The resulting binary vectors were similar to those described in Example 4 and were used to express plastid targeted and untargeted TIC860 (coding sequence: SEQ ID NO: 6; protein sequence: SEQ ID NO: 7), TIC867 (coding sequence: SEQ ID NO: 9; protein sequence: SEQ ID NO: 10), TIC868 (coding sequence: SEQ ID NO: 27; protein sequence: SEQ ID NO: 28), and TIC867_23 (coding sequence: SEQ ID NO: 20; protein sequence: SEQ ID NO: 23).

Cotton plant cells were transformed by an *Agrobacterium*-mediated transformation method. Transformed cotton cells were induced to form whole plants. Cotton leaf tissue was used in bioassay as described in Example 5 against Cotton Boll Worm (CBW, *Helicoverpa zea*), FAW, TBW and SBL. Table 9 shows the activity observed against these Lepidopteran species for TIC860, TIC867, and TIC868 in stably transformed $R_0$ generation cotton, wherein '+' indicate activity. As can be seen in Table 9, TIC860, TIC867, and TIC868 demonstrated activity against two or more Lepidopteran pest species in stably transformed $R_0$ generation cotton.

TABLE 9

Bioassay activity of TIC860, TIC867 and TIC868 from stably transformed $R_0$ cotton leaf tissue.

| Toxin | CBW | FAW | TBW | SBL |
| --- | --- | --- | --- | --- |
| TIC860 |  | + |  | + |
| TIC867 | + | + | + | NT |
| TIC868 |  | + |  | + |

Selected transformation events were used to produce $R_1$ seed. $R_1$ Plants expressing TIC860, TIC867, and TIC868 were assayed for resistance to CBW, FAW, TBW, and SBL. Leaf, square and boll tissues were used in assay. Table 10 shows the activity observed in these tests. A '+' sign indicates activity observed to the specific insect pest. As demonstrated in Table 10, TIC860 demonstrated activity against FAW in the leaf tissue. Further, the chimeric insecticidal protein TIC867 demonstrated activity against CBW and FAW in the leaf, square and boll tissues, as well as TBW and SBL in the leaf. The chimeric insecticidal protein TIC868 demonstrated activity against FAW in the leaf, square and boll tissues, as well as TBW and SBL in the leaf.

TABLE 10

Bioassay activity of chimeric insecticidal proteins from stably transformed $R_1$ cotton leaf tissue.

| Toxin | CBW | | | FAW | | | TBW | SBL |
| --- | --- | --- | --- | --- | --- | --- | --- | --- |
| | Leaf | Square | Boll | Leaf | Square | Boll | Leaf | Leaf |
| TIC860 |  |  |  | + |  |  |  |  |
| TIC867 | + | + | + | + | + | + | + | + |
| TIC868 |  |  |  | + | + | + | + | + |

Example 8

Cloning of Lepidopteran-Active Novel Chimeric Insecticidal Protein Coding Sequences Recombinant nucleic acid sequences were constructed from known Cry protein genes using to produce coding sequences encoding novel chimeric insecticidal proteins. The resulting coding sequences were cloned into a *Bacillus thuringiensis* (Bt) expression plasmid vector. After confirmation of the cloned sequence, the expression plasmid was transformed into Bt and expressed. Preparations of the expressed novel chimeric Cry proteins were assayed for activity against various Lepidopteran pests. Many coding sequences encoding chimeric insecticidal proteins were produced and tested in bioassay. Not all of the chimeric insecticidal proteins demonstrated activity. Only a few of the chimeric insecticidal proteins were selected based upon their activity to specific Lepidoptera, and are presented in Table 11 below.

TABLE 11

Novel chimeric pesticidal proteins and their corresponding bacterial coding sequence and protein sequence.

| Pesticidal Protein | Bacterial DNA SEQ ID NO: | Protein SEQ ID NO: |
| --- | --- | --- |
| TIC713 | 54 | 55 |
| TIC843 | 56 | 57 |
| TIC862 | 58 | 59 |
| TIC1099 | 60 | 61 |
| TIC1103 | 78 | 79 |
| TIC1101 | 80 | 81 |
| TIC845 | 82 | 83 |
| TIC846 | 84 | 85 |
| TIC858 | 86 | 87 |
| TIC865 | 88 | 89 |
| TIC866 | 90 | 91 |
| TIC838 | 92 | 93 |
| TIC839 | 94 | 95 |
| TIC841 | 96 | 97 |
| TIC842 | 98 | 99 |
| TIC850 | 100 | 101 |
| TIC859 | 102 | 103 |
| TIC861 | 104 | 105 |
| TIC848 | 106 | 107 |
| TIC849 | 108 | 109 |
| TIC847 | 110 | 111 |

Example 9

The Novel Chimeric Insecticidal Proteins Demonstrate Activity Against Lepidopteran Pests Coding sequences encoding chimeric insecticidal proteins were expressed in Bt. The expressed proteins were then assayed against a variety of Lepidoptera known to be pests of corn, sugarcane, soybean and cotton, as well as other crop plants. The insecticidal proteins were assayed for activity against Velvetbean caterpillar (VBC, *Anticarsia gemmatalis*), Sugarcane borer (SCB, *Diatraea saccharalis*), Lesser cornstalk borer (LSCB, *Elasmopalpus lignosellus*), Corn earworm (CEW, *Helicoverpa zea*), Tobacco budworm (TBW, *Heliothis virescens*), Soybean looper (SBL, *Chrysodeixis includens*), Black armyworm (BLAW, *Spodoptera cosmioides*), Southern armyworm (SAW, *Spodoptera eridania*), Fall armyworm (FAW, *Spodoptera frugiperda*), Beet armyworm (BAW, *Spodoptera exigua*), Old World bollworm (OBW, *Helicoverpa armigera*), Oriental leafworm (OLW, *Spodoptera litura*), Pink bollworm (PBW, *Pectinophora gossypiella*), Black cutworm (BCW, *Agrotis ipsilon*), Southwestern Corn Borer (SWCB, *Diatraea grandiosella*) and European corn borer (ECB, *Ostrinia nubilalis*). Corn earworm (CEW, *Helicoverpa zea*) is also referred to as Soybean pod worm (SPW) and Cotton bowl worm (CBW). Activity was determined through a combination of mortality and stunting scores as well as MIC50 scores. MIC50 refers to a molt inhibition concentration wherein both the dead larvae and L1 larvae (larvae that failed to mol to second instars) are factored into the score. Table 12 below shows the activity of each chimeric insecticidal protein. A '+' sign indicates activity observed to the specific insect pest.

TABLE 12

Bioassay activity against selected *Lepidoptera*.

| PRT SEQ ID NO: | VBC | SCB | LSCB | CEW SPW CBW | TBW | SBL | BLAW | SAW | FAW | BAW | OBW | OLW | PBW | BCW | SWCB | ECB |
|---|---|---|---|---|---|---|---|---|---|---|---|---|---|---|---|---|
| 55 | + | + | + | + | + | + | + |   | + | + | + | + | + |   | + | + |
| 57 | + | + | + | + | + | + | + |   |   | + |   | + | + |   | + |   |
| 59 | + | + | + | + | + | + |   | + | + |   |   |   |   |   | + |   |
| 61 | + | + |   | + |   | + | + |   | + | + | + | + | + |   | + | + |
| 79 | + | + |   | + | + | + | + |   |   | + | + | + | + | + | + | + |
| 81 | + | + |   |   |   | + | + |   |   |   |   |   |   |   | + |   |
| 83 | + | + |   |   |   | + |   | + |   | + |   |   | + |   | + |   |
| 85 | + | + |   |   |   | + |   | + |   |   | + |   |   |   | + |   |
| 87 | + | + |   |   |   | + |   | + |   | + |   | + |   |   | + |   |
| 89 | + | + | + |   | + |   | + | + |   | + |   |   |   |   | + |   |
| 91 | + | + |   |   |   | + |   |   | + |   |   | + |   |   | + |   |
| 93 | + | + | + |   | + | + |   | + | + | + |   |   |   |   | + |   |
| 95 | + | + |   |   |   | + | + | + |   |   |   |   |   |   | + |   |
| 97 | + | + |   |   |   | + | + |   |   |   |   | + |   |   | + |   |
| 99 | + | + | + |   | + | + | + | + | + | + | + |   |   | + | + |   |
| 101 | + |   |   |   |   | + | + | + | + | + |   | + |   | + | + |   |
| 103 | + | + |   |   | + | + | + | + | + | + |   | + |   | + | + |   |
| 105 | + | + |   |   |   | + |   | + |   |   |   |   |   |   | + |   |
| 107 | + | + |   | + | + | + | + |   | + | + | + | + |   |   |   |   |
| 109 | + | + |   | + | + | + | + |   | + | + | + | + |   |   |   |   |
| 111 | + | + |   |   | + | + |   | + | + |   |   | + | + |   | + |   |

As can be seen in Table 12 above, all of the chimeric insecticidal proteins exhibited activity against multiple Lepidopteran species.

Example 10

Amino Acid Variants of TIC1099 Demonstrate Lepidopteran Activity

The coding sequence for TIC1099 (SEQ ID NO: 60) was modified by methods known in the art to alter specific amino acids from the original TIC1099 protein sequence (SEQ ID NO: 61). The resultant variants were assayed for activity against selected Lepidoptera. Table 13 below shows the TIC1099 variants and the corresponding DNA and protein SEQ ID NOs.

TABLE 13

TIC1099 variants

| TIC1099 Variant | DNA SEQ ID NO: | PRT SEQ ID NO: |
|---|---|---|
| TIC1099-T507E | 62 | 63 |
| TIC1099-R522K | 64 | 65 |
| TIC1099-K490S | 66 | 67 |
| TIC1099-T562R | 68 | 69 |
| TIC1099-S553R | 70 | 71 |
| TIC1099-G498D | 72 | 73 |
| TIC1099-K490A | 74 | 75 |
| TIC1099-E564A | 76 | 77 |

Each variant was assayed for mortality and stunting against Fall armyworm (FAW, *Spodoptera frugiperda*), Corn earworm (CEW, *Helicoverpa zea*), Black cutworm (BCW, *Agrotis ipsilon*), Soybean looper (SBL, *Chrysodeixis includens*) and Southwestern Corn Borer (SWCB, *Diatraea grandiosella*). Table 14 below shows the activity against each Lepidopteran pest. The activity is rated from '+' to '++++' based upon the percent mortality.

TABLE 14

*Lepidoptera* activity of TIC1099 variants.

| TIC1099 Varient | PRT SEQ ID NO: | FAW | CEW | BCW | SBL | SWCB |
|---|---|---|---|---|---|---|
| TIC1099 | 61 | ++++ | +++ | ++++ | ++++ | +++ |
| TIC1099-T507E | 63 | ++++ | ++++ | ++++ | ++++ | ++++ |
| TIC1099-R522K | 65 | ++++ | ++++ | ++++ | +++ | ++++ |
| TIC1099-K490S | 67 | ++++ | +++ | ++++ | ++ | + |
| TIC1099-T562R | 69 | ++++ | ++++ | ++++ | ++++ | ++++ |
| TIC1099-S553R | 71 | ++++ | ++++ | ++++ | ++++ | ++++ |
| TIC1099-G498D | 73 | ++++ | ++++ | ++++ | ++++ | ++++ |
| TIC1099-K490A | 75 | ++++ | ++++ | ++++ | +++ | +++ |
| TIC1099-E564A | 77 | +++ | ++ | +++ | + | + |

All of the TIC1099 variants demonstrated activity against the five tested Lepidopteran species. A few of the variants demonstrated lower activity when compared to the others for specific pests.

Example 11

The Chimeric Insecticidal Proteins Expressed in Stably Transformed Corn Demonstrate Activity Against Lepidopteran Pests Synthetic coding sequences were constructed for use in expression of the encoded protein in plants, cloned into a binary plant transformation vector, and used to transform corn plant cells. The plant transformation vectors comprised a first transgene cassette for expression of the chimeric insecticidal protein which comprised a constitutive promoter, operably linked 5' to a leader, operably linked 5' to an intron, operably linked 5' to the chimeric insecticidal protein coding sequence, which was in turn operably linked 5' to a 3' UTR and; a second transgene cassette for the selection of transformed plant cells using glyphosate selection. Table 15 below shows the chimeric insecticidal protein coding sequences used for expression in corn and the corresponding SEQ ID NOs.

TABLE 15

Insecticidal protein coding sequences and corresponding SEQ ID NOs.

| Insecticidal Protein | DNA SEQ ID NO: | PRT SEQ ID NO: |
|---|---|---|
| TIC713 | 112 | 55 |
| TIC713 | 113 | 55 |
| TIC843 | 114 | 57 |
| TIC862 | 115 | 59 |
| TIC1099 | 116 | 61 |
| TIC1103 | 117 | 79 |
| TIC845 | 118 | 83 |
| TIC846 | 119 | 85 |
| TIC858 | 120 | 87 |
| TIC866 | 121 | 91 |
| TIC838 | 122 | 93 |
| TIC841 | 123 | 97 |
| TIC842 | 124 | 99 |
| TIC850 | 125 | 101 |
| TIC859 | 126 | 103 |
| TIC861 | 127 | 105 |
| TIC848 | 128 | 107 |
| TIC849 | 129 | 109 |
| TIC847 | 130 | 111 |

Corn variety LH244 was transformed with the binary transformation vectors described above using an *Agrobacterium*-mediated transformation method. The transformed cells were induced to form plants by methods known in the art. Bioassays using plant leaf disks were performed analogous to those described in U.S. Pat. No. 8,344,207. A non-transformed LH244 plant was used to obtain tissue to be used as a negative control. Multiple transformation events from each binary vector were assessed against Corn earworm (CEW, *Helicoverpa zea*), Fall armyworm (FAW, *Spodoptera frugiperda*), Black cutworm (BCW, *Agrotis ipsilon*) and Southwestern Corn Borer (SWCB, *Diatraea grandiosella*). The assay results are shown in Table 16 below wherein '+' indicate activity.

TABLE 16

Bioassay activity of chimeric insecticidal proteins from stably transformed corn leaf tissue.

| Insecticidal Protein | CEW | FAW | BCW | SWCB |
|---|---|---|---|---|
| TIC713 | + | + | | + |
| TIC843 | + | + | | + |
| TIC862 | + | + | | + |
| TIC1099 | + | + | + | + |
| TIC1103 | + | + | | + |
| TIC845 | + | + | | + |
| TIC846 | + | + | | + |
| TIC858 | + | + | | + |
| TIC866 | + | + | | + |
| TIC838 | | + | | + |
| TIC841 | + | + | | + |
| TIC842 | + | + | + | + |
| TIC850 | + | + | | + |
| TIC859 | + | + | | + |
| TIC861 | + | + | | + |
| TIC848 | + | + | | + |
| TIC849 | + | + | | + |
| TIC847 | | + | | + |

As can be seen in Table 16 above, all of the chimeric insecticidal proteins demonstrated activity against two or more Lepidopteran species.

Example 12

The Chimeric Insecticidal Proteins Expressed in Stably Transformed Soybean Demonstrate Activity Against Lepidopteran Pests The coding sequences for selected chimeric insecticidal proteins were redesigned for plant expression, cloned into a binary plant transformation vector, and used to transform soybean plant cells. The plant transformation vectors comprised a first transgene cassette for expression of the chimeric insecticidal protein which comprised a constitutive promoter, operably linked 5' to a leader, operably linked 5' to the chimeric insecticidal protein coding sequence, which was in turn operably linked 5' to a 3' UTR and; a second transgene cassette for the selection of transformed plant cells using spectinomycin selection. Table 17 below shows the chimeric insecticidal protein coding sequences used for expression in soybean and the corresponding SEQ ID NOs.

TABLE 17

Insecticidal protein coding sequences and corresponding SEQ ID NOs.

| Insecticidal Protein | DNA SEQ ID NO: | PRT SEQ ID NO: |
|---|---|---|
| TIC1103 | 117 | 79 |
| TIC866 | 121 | 91 |
| TIC842 | 124 | 99 |
| TIC849 | 129 | 109 |

Soybean plant cells were transformed using the binary transformation vectors described above by *Agrobacterium*-mediated transformation. The resulting transformed plant cells were induced to form whole soybean plants. Leaf tissue was harvested and used in bioassay as described in Example 11 or alternatively, lyophilized tissue was used in the insect diet for bioassay. Bioassay was performed against Fall armyworm (FAW, *Spodoptera frugiperda*), Southern armyworm (SAW, *Spodoptera eridania*), Soybean looper (SBL, *Chrysodeixis includens*), Soybean Pod Worm (SPW, *Helicoverpa zea*), Velvetbean caterpillar (VBC, *Anticarsia gemmatalis*), Soybean looper (SBL, *Chrysodeixis includens*), Tobacco budworm (TBW, *Heliothis virescens*), Black armyworm (BLAW, *Spodoptera cosmioides*), Southern armyworm (SAW, *Spodoptera eridania*), Lesser cornstalk borer (LSCB, *Elasmopalpus lignosellus*) and Old World bollworm (OBW, *Helicoverpa armigera*). Table 18 below shows the activity against selected species of Lepidoptera for each insecticidal protein in R0 generation plants.

TABLE 18

Bioassay activity of chimeric insecticidal proteins from stably transformed R0 soybean leaf tissue.

| Insecticidal Protein | FAW | SAW | SBL | SPW | VBC | TBW | BLAW | SAW | LSCB | OBW |
|---|---|---|---|---|---|---|---|---|---|---|
| TIC1103 |   | + | + | + | + | + |   |   | + | + |
| TIC866  | + |   | + |   | + |   |   |   | + | + |
| TIC842  | + | + | + |   | + | + | +  | + | + | + |
| TIC849  |   | + | + | + | + | + |   |   | + |   |

As can be seen in Table 18, each of the chimeric insecticidal proteins expressed in stably transformed soybean demonstrated activity against multiple Lepidopteran species.

Selected transformed events were allowed to self-pollinate and the resulting seed was grown. Leaf tissue was harvested from the R1 generation plants and used in a feeding bioassay. Table 19 shows the activity observed against selected Lepidopteran species from insecticidal proteins expressed in the R1 generation soybean leaf tissue.

TABLE 19

Bioassay activity of chimeric insecticidal proteins from stably transformed R1 soybean leaf tissue.

| Toxin | SAW | SBL | SPW | VBC |
|---|---|---|---|---|
| TIC1103 |   | + | + | + |
| TIC866  | + | + |   | + |
| TIC842  |   | + | + |   |
| TIC849  |   | + | + |   |

As can be seen in Table 19 above, the expressed chimeric insecticidal proteins from R1 generation plants demonstrated activity to two or more Lepidopteran species.

Example 13

Lepidopteran Activity of the Chimeric Insecticidal Proteins in Stably Transformed Corn

This Example illustrates the inhibitory activity exhibited by the TIC838 chimeric insecticidal protein against Lepidopteran pests when expressed in corn plants and provided as a diet to the respective corn insect pest.

Corn variety LH244 was transformed with the binary transformation vectors described in Example 4 using an *Agrobacterium*-mediated transformation method. The transformed cells were induced to form plants by methods known in the art. Bioassays using plant leaf disks were performed analogous to those described in U.S. Pat. No. 8,344,207. A non-transformed LH244 plant was used to obtain tissue to be used as a negative control. Multiple transformation events the binary vector were assessed against Corn earworm (CEW, *Helicoverpa zea*), Fall armyworm (FAW, *Spodoptera frugiperda*), and Southwestern Corn Borer (SWCB, *Diatraea grandiosella*).

Leaf disc bioassay was performed on $R_0$ generation transgenic plants. In addition, leaf damage ratings were assessed for whole transgenic $F_1$ plants in the greenhouse. $F_1$ transgenic events were also assessed for activity in the field against FAW and SWCB at three different sites. Assay against SWCB in the field was performed two times at the three different sites, while assay against FAW was performed once in each of the three sites. The assay results are shown in Table 4. A '+' sign indicates activity observed to the specific insect pest. As can be seen in Table 4, the TIC838 chimeric insecticidal protein demonstrated activity against the Lepidopteran pest species FAW and SWCB in $R_0$ generation transgenic plants in leaf disc bioassay and demonstrated activity against SWCB in whole plant feeding studies in the greenhouse and field.

TABLE 20

Activity of TIC838 from $R_0$ and $F_1$ stably transformed corn plants.

| R0 Leaf Disk | | | Greenhouse trial | | | Field Trials | |
|---|---|---|---|---|---|---|---|
| CEW | FAW | SWCB | CEW | FAW | SWCB | FAW | SWCB |
|  | + | + |  |  | + |  | + |

Example 14

Assay of Activity of TIC838 in Stably Transformed Soybean Against Lepidopteran Insect Pests

This Example illustrates assaying TIC838 for Lepidopteran-inhibitory activity in stably transformed soybean plants.

Binary plant transformation vectors comprising transgene cassettes designed to express both plastid targeted and untargeted TIC838 insecticidal protein are cloned using methods known in the art. Tissues are harvested from the transformants and used in insect bioassay against various Lepidopteran insects. The plant transformation vectors comprise a first transgene cassette for expression of the TIC838 chimeric insecticidal protein as described in Example 4 and a second transgene cassette for the selection of transformed plant cells using spectinomycin selection.

Soybean plant cells are transformed using the binary transformation vectors described above by *Agrobacterium*-mediated transformation. The resulting transformed plant cells are induced to form whole soybean plants. Leaf tissue is harvested and used in bioassay as described in Example 5 or alternatively, lyophilized tissue is used in the insect diet for bioassay. Bioassay is performed against Fall armyworm (FAW, *Spodoptera frugiperda*), Southern armyworm (SAW, *Spodoptera eridania*), Soybean looper (SBL, *Chrysodeixis includens*), Soybean Pod Worm (SPW, *Helicoverpa zea*), Velvetbean caterpillar (VBC, *Anticarsia gemmatalis*), Tobacco budworm (TBW, *Heliothis virescens*), Black armyworm (BLAW, *Spodoptera cosmioides*), Lesser cornstalk borer (LSCB, *Elasmopalpus lignosellus*) and Old World bollworm (OBW, *Helicoverpa armigera*); as well as other Lepidopteran insect pests. Measurements of activity such as mortality and stunting of the Lepidopteran insect pest are recorded and used to determine the effectiveness of TIC838 in controlling the insect pest when expressed in soybean tissues. Whole plant assays are also performed in the greenhouse and field to assess damage to various organs such as, but not limited to, the leaf, flower, pod, and seed.

Example 15

Assay of Activity of TIC838 in Stably Transformed Cotton Against Lepidopteran Insect Pests This Example illustrates assaying TIC838 for Lepidopteran-inhibitory activity in stably transformed cotton plants.

Binary plant transformation vectors comprising transgene cassettes designed to express both plastid targeted and untargeted TIC838 insecticidal protein are cloned using methods known in the art. Tissues are harvested from the transformants and used in insect bioassay against various Lepidopteran insects. The plant transformation vectors comprise a first transgene cassette for expression of the TIC838 chimeric insecticidal protein as described in Example 4 and a second transgene cassette for the selection of transformed plant cells using spectinomycin selection.

Cotton plant cells are transformed using the binary transformation vectors described above by *Agrobacterium*-mediated transformation. The resulting transformed plant cells are induced to form whole soybean plants. Leaf tissue is harvested and used in bioassay as described in Example 5 or alternatively, lyophilized tissue is used in the insect diet for bioassay. Bioassay is performed against Cotton bowlworm (CBW, *Helicoverpa zea*), Fall armyworm (FAW, *Spodoptera frugiperda*), Soybean looper (SBL, *Chrysodeixis includens*), and Tobacco budworm (TBW, *Heliothis* virescens); as well as other Lepidopteran insect pests. Measurements of activity such as mortality and stunting of the Lepidopteran insect pest are recorded and used to determine the effectiveness of TIC838 in controlling the insect pest when expressed in soybean tissues. Tissues such as $R_0$ leaf, $R_0$ squares, $R_0$ bolls, $R_1$ leaf, $R_1$ squares and $R_1$ bolls are used in bioassay to determine the activity of TIC838 against the Lepidopteran insect pest species. Measurements of activity such as mortality and stunting of the Lepidopteran insect pest are recorded and used to determine the effectiveness of TIC838 in controlling the insect pest when expressed in soybean tissues. Whole plant assays are also performed in the greenhouse and field to assess damage to various organs such as, but not limited to, leaves, squares, and bolls.

All of the compositions disclosed and claimed herein can be made and executed without undue experimentation in light of the present disclosure. While the compositions of this invention have been described in terms of the foregoing illustrative embodiments, it will be apparent to those of skill in the art that variations, changes, modifications, and alterations may be applied to the composition described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

All publications and published patent documents cited in the specification are incorporated herein by reference to the same extent as if each individual publication or patent application was specifically and individually indicated to be incorporated by reference.

SEQUENCE LISTING (130 sequences)

SEQ ID NO: 1 - DNA, 3570 bp, Artificial
  Recombinant nucleotide sequence used for expression in a bacterial cell encoding TIC1100.
atggagatagtgaataatcagaatcaatgcgtgccttataattgtttgaataatcccgaaatcgaaatattagaaggcggaagaatatcagttggtaataccccaattgatatttctctttcgcttactcagtttcttttgagtgaatttgtcccaggtgcggggtttgtattaggattaattgatttaatatggggatttgtaggtccttcccaatgggacgcatttcttgctcaagtggaacagttaattaaccaaagaatagcagaagctgtaagaaatacagcaattcaggaattagagggaatggcacgggtttatagaacctatgctactgcttttgctgagtgggaaaaagctcctgatgacccagagctaagagaagcactacgtacacaatttacagcaactgagacttatataagtggaagaatatccgttttaaaaattcaaacttttgaagtacagctgttatcagtgtttgcccaagctgcaaatttacatttatctttattaagagacgttgtgttttttgggcaaagatggggtttttcaacgacaaccgtaaataattactacaatgatttaacagaagggattagtacctatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatga

SEQ ID NO: 2 - DNA, 3570 bp, Artificial
  Synthetic nucleotide sequence designed for expression in a plant cell encoding TIC1100.
atggagattgtgaacaaccagaaccagtgcgttccttacaactgcttgaacaaccctgagattgagattcttgagggtggtagaatttctgttggcaacactcctattgacatctctttgagtttgactcaattcttgttgagtgagttcgttcctggtgctggtttcgtcttgggtttgattgatttgatttggggtttcgttggtcctagtcaatgggatgctttcttggctcaagttgagcaattgattaaccagaggatcgctgaggctgtgaggaacactgctattcaagagttggagggtatggctagagtttacagaacttacgctactgctttcgctgagtgggagaaggctcctgatgaccctgagttgagggaggctttgagaactcaattcactgctactgagacttacatcagtggtagaatcagtgtcttgaagattcaaactttcgaggttcaattgctttctgtgttcgctcaagctgcaaacttgcacttgtctttgcttagagatgttgtgttctttggtcaaagatggggtttctccactactaccgtgaacaattactacaacgatttgactgagggtatttctacttacactgattacgctgttagatggtacaacactggtttggagagagtttggggtccagattccagagattgggtcagatacaaccagttcagaagggagttgactttgactgtcttggacattgttgctctcttccctaactacgatagtcgtcgttaccctattagaactgtttctcaacttactagggaaatctacactaaccctgttcttgagaacttcgatggtagtttccgtggtagtgctcaagggattgagcgttctattcgttctcctcatcttatggacattcttaactctattactatctacactgatgctcatcgtggttactattactggtctggtcatcaaattatggctagtcctgttggtttcagtggtcctgagttcactttccctctttacggtactatgggcaacgctgcacctcaacagaggatcgttgctcaacttggtcaaggtgtttacaggactctttcttcaaccctttacaggcgtcctttcaacattgggatcaacaaccagcagctttctgttcttgatggaaccgagttcgcttacggaacctcttcaaaccttcctagtgctgtttacaggaagtctggaaccgttgacagtcttgatgagattccaccgcagaacaataacgttccacccaggcaaggcttcagtcataggctttctcatgtttctatgttccgctctggattcagcaactcttcagtttctattatcagggctccaatgttctcgtggattcataggtctgccgagttcaacaacattatcgcttccgatagcattaaccagattccacttgttaagggattccgtgtttggggaggcacctctgttattaccggaccaggcttcaccggaggcgacattcttcgtcgtaacaccttcggagatttcgtttcacttcaagtgaacattaactcaccaatcacccagcgctacaggcttcgcttccgctacgcatcatccagggatgcaagggtgatcgtgcttaccggagcagcctcaaccggagtgggaggccaagtgagcgtgaacatgccacttcagaagacgatggagatcggcgagaaccttacctcaagaacctttcgttacaccgatttcagcaacccattcagctttcgtgcaaacccagacatcatagggatctcagagcagccactgtttggagctggatcaatctcatccggagagctttacatcgacaagatcgagatcatactcgcagatgcaaccttcgaggctgagagcgatctggagcgtgcacagaaggcagtgaacgcactctttacctctaccaaccagctcggactcaagaccaacgtgaccgattaccacatcgaccaagtgagcaacctcgtgacctacctctcagatgagttctgcttggatgagaaacgcgaactcagcgagaaggtgaagcacgcaaagcgtctctcagatgagcgtaacctcctccaggatagcaatttcaaggacatcaatcgtcagccagagcgtggatggggaggctcaaccggaatcaccatccagggaggcgatgatgtgtttaaggagaattacgtgacactctccggaacattcgatgagtgctacccaacatacctctatcagaagatcgacgagtccaagctcaaggcgttcacccgttatcagctccgtggctacatcgaggatagtcaagacctggaaatctacctcatccgctacaatgcaaagcacgagacagtgaatgtgccaggaacaggctccctctggccactctccgcacagtctccaatcggcaagtgcggcgagccaaatcgctgcgcgccacacctggagtggaatcccgacctggactgctcctgccgcgacggcgagaagtgcgcccaccactcccaccactttagcctggacatcgacgtgggctgtacagacctgaatgaggatctgggcgtgtgggtgatctttaagatcaagacacaggacggccacgcccgcctgggcaatctggagtttctggaggagaagcctctggtgggcgaagccctggcccgcgtgaagcgcgccgagaagaaatggcgcgacaaacgcgagaaactggaatgggaaacaaacatcgtgtacaaagaagccaaagaatccgtggacgccctatttgtgaactcccagtatgaccagctacaggccgacacaaacatcgcgatgatccacgctgcggacaagcgcgtgcactccatacgcgaagcctatctacccgaactatccgtgatacccggcgtcaatgccgcgatctttgaagaattggaaggccgcatcttcacagcctttagcctctatgacgcccgaaatgtcatcaagaatggcgactttaacaatgggctatcctgttggaatgtcaaagggcacgtggacgtcgaagagcagaacaatcagcgatccgtcttagtcgtacccgaatgggaagccgaagtctcccaggaagtccgagtctgtcctggtagaggttacatcttgagagtgactgcttacaaggagggttacggtgagggatgcgtgactattcacgagattgagaacaacactgatgagttgaagttcagtaactgcgtggaggaggaaatctaccccaacaacactgtgacttgtaacgattacaccgtgaaccaggaggaatacggaggcgcttacacctccagaaaccgtggatacaatgaggctccctcggtccccgctgattatgcctccgtctatgaggagaagtcctacaccgatggaaggcgcgagaatccctgcgagttcaatcgcggctatcgagactacactccgctacccgttggctatgtcacaaaggaactggaatacttcccggaaacagacaaagtctggatcgaaatcggcgaaacagaagggacgttcatagtcgatagcgtagaacttctccttatggaagaatga

SEQ ID NO: 3 - DNA, 3570 bp, Artificial
  Synthetic nucleotide sequence designed for expression in a plant cell encoding TIC1100.
atggagattgtgaacaaccagaaccagtgcgttccttacaactgcttgaacaaccctgagattgagattcttgagggtggtagaatttctgttggcaacactcctattgacatctctttgagtttgactcaattcttgttgagtgagttcgttcctggtgctggtttcgtcttgggtttgattgatttgatttggggtttcgttggtcctagtcaatgggatgctttcttggctcaagttgagcaattgattaaccagaggatcgctgaggctgtgaggaacactgctattcaagagttggagggtatggctagagtttacagaacttacgctactgctttcgctgagtgggagaaggctcctgatgaccctgagttgagggaggctttgagaactcaattcactgctactgagacttacatcagtggtagaatcagtgtcttgaagattcaaactttcgaggttcaattgctttctgtgttcgctcaagctgcaaacttgcacttgtctttgcttagagatgttgtgttctttggtcaaagatggggtttctccactactaccgtgaacaattactacaacgatttgactgagggtatttctacttacactgattacgctgttagatggtacaacactggtttggagagagtttggggtccagattccagagattgggtcagatacaaccagttcagaagggagttgactttgactgtcttggacattgttgctctcttccctaactacgatagtcgtcgttaccctattagaactgtttctcaacttactagggaaatctacactaaccctgttcttgagaacttcgatggtagtttccgtggtagtgctcaagggattgagcgttctattcgttctcctcatcttatggacattcttaactctattactatctacactgatgctcatcgtggttactattactggtctggtcatcaaattatggctagtcctgttggtttcagtggtcctgagttcactttccctctttacggtactatgggcaacgctgcacctcaacagaggatcgttgctcaacttggtcaaggtgtttacaggactctttcttcaaccctttacaggcgtcctttcaacattgggatcaacaaccagcagctttctgttcttgatggaaccgagttcgcttacggaacctcttcaaaccttcctagtgctgtttacaggaagtctggaaccgttgacagtcttgatgagattccaccgcagaacaataacgttccacccaggcaaggcttcagtcataggctttctcatgtttctatgttccgctctggattcagcaactcttcagtttctattatcagggctccaatgttctcgtggattcataggtctgccgagttcaacaacattatcgcttccgatagcattaaccagattccacttgttaagggattccgtgtttggggaggcacctctgttattaccggaccaggcttcaccggaggcgacattcttcgtcgtaacaccttcggagatttcgtttcacttcaagtgaacattaactcaccaatcacccagcgctacaggcttcgcttccgctacgcatcatccagggatgcaagggtgatcgtgcttaccggagcagcctcaaccggagtgggaggccaagtgagcgtgaacatgccacttcagaagacgatggagatcggcgagaaccttacctcaagaacctttcgttacaccgatttcagcaacccattcagctttcgtgcaaacccagacatcatagggatctcagagcagccactgtttggagctggatcaatctcatccggagagctttacatcgacaagatcgagatcatactcgcagatgcaaccttcgaggctgagagcgatctggagcgtgcacagaaggcagtgaacgcactctttacctctaccaaccagctcggactcaagaccaacgtgaccgattaccacatcgaccaagtgagcaacctcgtgacctacctctcagatgagttctgcttggatgagaaacgcgaactcagcgagaaggtgaagcacgcaaagcgtctctcagatgagcgtaacctcctccaggatagcaatttcaaggacatcaatcgtcagccagagcgtggatggggaggctcaaccggaatcaccatccagggaggcgatgatgtgtttaaggagaattacgtgacactctccggaacattcgatgagtgctacccaacatacctctatcagaagatcgacgagtccaagctcaaggcgttcacccgttatcagctccgtggctacatcgaggatagtcaagacctggaaatctacctcatccgctacaatgcaaagcacgagacagtgaatgtaccaggaacaggctccctctggccactctccgcacagtctccaatcggcaagtgcggcgagccaaatcgctgcgcgccacacctggagtggaatcccgacctggactgctcctgccgcgacggcgagaagtgcgcccaccactcccaccactttagcctggacatcgacgtgggctgtacagacctgaatgaggatctgggcgtgtgggtgatctttaagatcaagacacaggacggccacgcccgcctgggcaatctggagtttctggaggagaagcctctggtgggcgaagccctggcccgcgtgaagcgcgccgagaagaaatggcgcgacaaacgcgagaaactggaatgggaaacaaacatcgtgtacaaagaagccaaagaatccgtggacgccctatttgtgaactcccagtatgaccagctacaggccgacacaaacatcgcgatgatccacgctgcggacaagcgcgtgcactccatacgcgaagcctatctacccgaactatccgtgatacccggcgtcaatgccgcgatctttgaagaattggaaggccgcatcttcacagcctttagcctctatgacgcccgaaatgtcatcaagaatggcgactttaacaatgggctatcctgttggaatgtcaaagggcacgtggacgtcgaagagcagaacaatcagcgatccgtcttagtcgtacccgaatgggaagccgaagtctcccaggaagtccgagtctgtcctggtagaggttacatcttgagagtgactgcttacaaggagggttacggtgagggatgcgtgactattcacgagattgagaacaacactgatgagttgaagttcagtaactgcgtggaggaggaaatctaccccaacaacactgtgacttgtaacgattacaccgtgaaccaggaggaatacggaggcgcttacacctccagaaaccgtggatacaatgaggctccctcggtccccgctgattatgcctccgtctatgaggagaagtcctacaccgatggaaggcgcgagaatccctgcgagttcaatcgcggctatcgagactacactccgctacccgttggctatgtcacaaaggaactggaatacttcccggaaacagacaaagtctggatcgaaatcggcgaaacagaagggacgttcatagtcgatagcgtagaacttctccttatggaagaatga

SEQ ID NO: 4 - protein, 1189 aa, Artificial
  Amino acid sequence of the chimeric protein TIC1100.
MEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 5 - DNA, 3672 bp, Artificial
  Recombinant nucleotide sequence used for expression in a bacterial cell encoding TIC860.
atgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgagacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaatacgattggaccaaatagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 6 - DNA, 3672 bp, Artificial
  Synthetic nucleotide sequence designed for expression in a plant cell encoding TIC860.
atgaccagcaaccggaagaacgagaacgagatcatcaacgccctgagcatcccgaccgtgagcaaccctagcacccagatgaacctgagccctgacgctcgcatcgaggactccctctgcgtggctgaggtgaacaacatcgacccgttcgtgtccgcctccaccgtgcagaccggcatcaacatcgcgggccgcatcctcggcgtgctcggcgtgccctttgcgggccagctcgcctccttctactccttcctcgtgggagagctgtggccctccggccgcgacccgtgggagatcttcctggagcacgtggagcagctcatccgccagcaagtcaccgagaacacccgcaacaccgccatcgcccgcctggagggcctgggccgtggctaccgctcctaccagcaagccctggagacctggctcgacaaccgcaacgacgcccgctcccgctccatcatcctggagcgctacgtcgccctggaactggacatcaccactgccatcccactcttccgcatcaggaacgaggaggtgcctctgctgatggtgtacgcccaggctgcgaacctgcacctgctgctgctgcgcgacgcaagcctgtttggctccgagtggggtatggcaagctccgacgtcaaccagtactaccaggagcagatccgctacaccgaggagtacagcaaccactgcgtccagtggtacaacaccggtctgaacaatctcagagggaccaacgctgagagctggctgcgctacaaccagttccggcgggatctgaccctaggtgtcctggatctggtcgctctgttcccgagctacgataccaggacgtaccctatcaacacctctgctcagcttaccagggagatctacactgatcctatcggtaggactaacgctcctagtggtttcgccagcactaactggttcaacaacaacgcgcctagtttctctgccatcgaggcggcgatcttccggcctcctcacctcctcgacttcccggagcagcttactatctactctgcgtcttcgcggtggtcttcgactcagcacatgaactactgggttggtcaccggcttaacttccgcccgattggaggaactcttaacaccagtacgcaaggtcttacgaacaacacttccatcaacccggttacgttgcagttcacgtctcgggacgtttaccggacggagtcgaatgctgggacgaacatcctgttcacgacaccggtgaatggtgttccgtgggcacgtttcaacttcatcaacccgcagaacatctacgagcgtggagcaacgacatactcgcaaccataccaaggcgttggcatccaactgtttgactcggagacggaactgccaccagagacgacagaacgtccgaattacgagtcatactcacacagactatcacacattggactcattatcggaaacacactgagagcaccagtgtactcatggacacatcggtcagcagatcgtacgaacaccatcggacccaatcggatcaaccagatcccgctcgtgaagggcttccgcgtgtggggcggcacctccgtcatcaccggtccgggcttcaccggcggcgacatcctccgccgcaacaccttcggcgacttcgtgtcactccaagtgaacatcaacagcccgatcacccagcgctatcgcctccgcttccgctacgcctcctcccgcgacgctagagtgatcgtgctcaccggagcggcgtccacaggcgtaggcggccaagtgtctgtgaacatgccgctccagaagactatggagattggtgagaacctcacctctcgcaccttccgctacaccgacttctccaatccgttctccttcagagccaacccagacatcatcggcatctccgagcagcctctctttggcgctggctccatctcctccggcgagctgtacatcgacaagattgagatcatccttgccgacgccaccttcgaagctgagtccgatctcgagcgcgcccagaaggccgtgaacgccctcttcactagcactaaccagctcggcctcaagactaacgtgaccgactaccacattgaccaagtgagcaacctagtgacctaccttagcgacgagttctgccttgacgagaagcgtgagctgagcgagaaggtgaagcacgccaagcgcctctccgacgagcgcaacctcctccaggactccaacttcaaggacatcaaccgccagcccgagcgcggctggggcggtagcaccggcatcaccatccagggcggtgacgatgtgttcaaggagaactacgtgaccctctccggcaccttcgacgagtgctacccgacctacctctaccagaagatcgacgagtccaagctcaaggcgttcacccgctaccagcttcgcggctacatcgaggactcccaggatctggagatctacctcatccgctacaacgccaagcacgagaccgtgaacgtgcccggcaccggctccctctggccgctctccgcccagagccctatcggcaagtgcggcgagcccaaccgctgcgcgcctcacctggagtggaaccctgacctcgactgctcctgccgcgacggcgagaagtgcgcccaccatagccaccacttctctctcgacatcgacgtgggctgcaccgacctcaacgaggatctgggcgtgtgggtgatcttcaagatcaagacccaggacggccacgccaggctgggcaacctggagttcctggaggagaagcctctggtgggtgaggccctggccagggtcaagagggctgagaagaaatggagggacaagagggagaagctggagtgggagaccaacatcgtgtacaaggaggctaaggagtccgtggacgctctgttcgtcaactctcagtacgatcagctccaggctgacaccaacatcgctatgatccacgctgcggataagagggtccactctatcagggaggcttacctgcctgagctttctgtcatccctggtgtcaacgcggcaatcttcgaggaacttgagggccgcatcttcactgcgttctcgctttacgatgcgcggaacgtcattaagaacggtgacttcaacaatggtctttcgtgctggaacgtcaagggtcatgtcgatgtcgaggaacagaacaaccagcggtcggtccttgtcgttcccgagtgggaggccgaggtctcgcaagaggtccgggtctgccctgggcgcgggtacattcttcgtgtcactgcgtacaaggagggctacggcgagggctgcgttactattcatgagattgagaacaatacggatgagcttaagtttagtaactgtgttgaggaggagatctacccgaacaatacggttacgtgcaatgattacacggtgaaccaggaggaatacggcggagcatacacctcacgtaatagagggtacaatgaggcaccgtcagttccggcagattatgcctcagtttatgaggagaagtcctacacggatggaagacgcgagaatccatgtgagtttaatagaggataccgagactacacaccactcccagttggatacgttacaaaggagttggaatacttcccagaaacagataaagtttggatagagatcggagaaacagaaggaaccttcatcgtggacagtgtagaactgctgctgatggaagaatga

SEQ ID NO: 7 - protein, 1223 aa, Artificial
  Amino acid sequence of the chimeric protein TIC860.
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 8 - DNA, 3564 bp, Artificial
  Recombinant nucleotide sequence used for expression in a bacterial cell encoding TIC867.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccttcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 9 - DNA, 3564 bp, Artificial
  Synthetic nucleotide sequence designed for expression in a plant cell encoding TIC867.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccttcgaagctgagtcggacctggagcgtgcacagaaggcagtcaacgagctgttcacctctagcaaccagatcggcctcaagaccgacgtcacagactaccacatcgaccaagtgtccaacctggtcgagtgccttagcgacgagttctgcctagacgagaagaaggagctgtcggagaaggtcaaacacgccaagcgtctgagcgatgagcgcaacctgctccaagaccctaacttccgtggcatcaacaggcagcttgaccgtggctggcgcggctcgacggacatcacgatccagggtggcgacgacgtattcaaggagaattacgtgaccttgcttgggacgtttgacgagtgctatcccacctacctctaccagaagattgatgaatcgaaattgaaggcgtacacgagataccagctccgtggctacatcgaggacagccaggacttggagatctacctcatacgctacaacgctaaacatgagaccgtgaacgtccctgggacgggcagtctgtggccactctctgctcctagccctatcggcaagtgcgctcaccactcgcaccacttcagccttgacatcgacgtgggatgtactgacctcaacgaagacctgggcgtctgggttatcttcaagatcaagacccaggacggccacgcccgactcggcaacctggagttcctggaggagaaaccactggtgggcgaggcgctcgcccgcgtgaagcgtgccgagaagaagtggcgggacaagagggagaagctagaatgggagacgaacatcgtgtacaaggaggccaaggaaagcgtcgatgccctgttcgtgaactcacagtacgaccgtctccaggcggacacgaacatcgccatgatccacgcggctgacaagcgcgtccactccatccgcgaggcgtacttaccggagctgtcggtgatcccaggcgtaaacgcggcgatcttcgaggagctagagggacgcatcttcacagcgttcagcctgtacgacgcacgcaacgtcatcaagaacggcgatttcaacaacggactgtcctgctggaacgtgaagggccacgtcgatgtcgaggaacagaacaaccaccgctctgtcctggtggtcccagagtgggaggccgaggtctcccaggaggtccgcgtgtgccctgggcgtggctacatcctccgtgtgacagcctacaaggagggctacggtgagggctgcgtcaccattcacgagatcgagaacaacactgacgaactcaagttctcgaattgcgtggaggaggaggtgtacccgaacaatacggtgacgtgcaacgactacacggcaacccaagaggagtacgagggcacctacaccagtaggaaccgtggctacgacggtgcctacgagtcgaactccagcgtccctgcggactacgccagcgcgtacgaggagaaggcttacaccgacggacgccgggacaacccatgcgagagcaaccgtggctacggcgactacactcctctcccggccggatacgtcacaaaggagctggagtatttcccagagacggacaaggtgtggatcgaaatcggagagacagagggaaccttcatcgtggacagcgtggagctgctcctcatggaggagtga

SEQ ID NO: 10 - protein, 1187 aa, Artificial
  Amino acid sequence of the chimeric protein TIC867.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 11 - DNA, 3642 bp, Artificial
  Recombinant nucleotide sequence used for expression in a bacterial cell encoding TIC867_20.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaacctttgaggcagaatatgatttagaaagagcgcaaaaggtggtgaatgccctgtttacgtctacaaaccaactagggctaaaaacagatgtgacggattatcatattgatcaggtatccaatctagttgcgtgtttatcggatgaattttgtctggatgaaaagagagaattgtccgagaaagttaaacatgcaaagcgactcagtgatgagcggaatttacttcaagatccaaacttcagagggatcaataggcaaccagaccgtggctggagaggaagtacggatattactatccaaggaggagatgacgtattcaaagagaattacgttacgctaccgggtacctttgatgagtgctatccaacgtatttatatcaaaaaatagatgagtcgaaattaaaagcctatacccgttatcaattaagagggtatatcgaagatagtcaagacttagaaatctatttaattcgttacaatgcaaaacacgaaatagtaaatgtaccaggtacaggaagtttatggcctctttctgtagaaaatcaaattggaccttgtggagaaccgaatcgatgcgcgccacaccttgaatggaatcctgatttacactgttcctgcagagacggggaaaaatgtgcacatcattctcatcatttctctttggacattgatgttggatgtacagacttaaatgaggacttaggtgtatgggtgatattcaagattaagacgcaagatggccacgcacgactagggaatctagagtttctcgaagagaaaccattattaggagaagcactagctcgtgtgaaaagagcggagaaaaaatggagagacaaacgcgaaacattacaattggaaacaactatcgtttataaagaggcaaaagaatctgtagatgctttatttgtaaactctcaatatgatagattacaagcggatacgaacatcgcgatgattcatgcggcagataaacgcgttcatagaattcgagaagcgtatctgccggagctgtctgtgattccgggtgtcaatgcggctatttttgaagaattagaagagcgtattttcactgcattttccctatatgatgcgagaaatattattaaaaatggcgatttcaataatggcttattatgctggaacgtgaaagggcatgtagaggtagaagaacaaaacaatcaccgttcagtcctggttatcccagaatgggaggcagaagtgtcacaagaggttcgtgtctgtccaggtcgtggctatatccttcgtgttacagcgtacaaagagggatatggagaaggttgcgtaacgatccatgagatcgagaacaatacagacgaactgaaattcaacaactgtgtagaagaggaagtatatccaaacaacacggtaacgtgtattaattatactgcgactcaagaagaatatgagggtacgtacacttctcgtaatcgaggatatgacgaagcctatggtaataacccttccgtaccagctgattatgcgtcagtctatgaagaaaaatcgtatacagatagacgaagagagaatccttgtgaatctaacagaggatatggagattacacaccactaccagctggttatgtaacaaaggaattagagtacttcccagagaccgataaggtatggattgagattggagaaacagaaggaacattcatcgtggacagcgtggaattactccttatggaggaatag

SEQ ID NO: 12 - DNA, 3642 bp, Artificial
  Synthetic nucleotide sequence designed for expression in a plant cell encoding TIC867_20.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccttcgaggccgagtacgaccttgagcgcgcccagaaggtggtgaacgccctcttcactagcactaaccagctaggcctgaagactgacgtgaccgactaccacatcgaccaagtgagcaacctagtggcctgcctctccgacgagttctgcctcgacgagaagcgcgagctgtccgagaaggtgaagcacgccaagcgcctctccgacgagcgcaacctgctccaggaccccaacttcaggggcatcaacaggcagcccgaccgcggctggcgcggctccaccgacatcaccatccagggcggtgacgacgtattcaaggagaactacgttaccctccccggcaccttcgacgagtgttaccccacctacctctaccagaagatcgacgagtccaagctgaaggcctacacccgctaccagctccgcggctacatcgaggactcccaggacctggaaatctacctcatccgctacaacgccaagcacgagatcgtgaacgtgcctggcaccggcagcctctggcctctcagcgtggagaaccagatcggcccttgcggcgagcctaaccgctgcgcccctcacctcgagtggaaccctgacctccactgctcgtgcagggacggcgagaagtgcgcccaccatagccaccacttctctctggacatcgacgtgggctgcaccgacctgaacgaggacctgggcgtgtgggttatcttcaagatcaagacccaggacggtcacgccaggctgggtaacctggagttccttgaggaaaagcctctgctgggtgaggccctggccagggtcaagagggctgagaagaaatggagggataagagggagaccctgcagctggagaccactatcgtctacaaggaggctaaggagtctgtcgatgctctgttcgtcaactctcagtacgatagactgcaagctgataccaacatcgctatgatccacgctgcggataagcgggtccaccggatccgggaggcttaccttccggagctttctgtcatcccgggtgtcaacgctgcgatcttcgaggaacttgaggaacggatcttcactgcgtttagtctttacgatgcgcggaacatcatcaagaacggggacttcaacaatggtctgctgtgctggaacgtcaagggtcatgtcgaggtcgaggaacaaaacaatcatcgtagtgtccttgtcattcctgagtgggaggcggaggtctctcaagaggtccgtgtttgcccggggcgtgggtacattcttcgtgttactgcgtacaaggaggggtacggggaggggtgcgttactattcatgagattgagaacaatactgatgagcttaagttcaacaattgtgttgaggaggaggtttacccgaacaatactgttacgtgcatcaactacacggcaacgcaagaggaatacgaggggacgtacacctcgcgtaatagagggtatgatgaggcgtacggaaacaacccgtcggttccagcagattatgcctcggtttatgaggagaagtcgtacacggatagacgacgcgagaatccatgtgagtcaaatcgaggatacggagattacacaccattaccagcaggatacgttacaaaggagttggaatacttcccggaaacagataaagtttggattgaaatcggagaaacagaaggaacattcatcgtcgactcagtagaattgttgttgatggaagaatga

SEQ ID NO: 13 - protein, 1213 aa, Artificial
  Amino acid sequence of the chimeric protein variant TIC867_20.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAEYDLERAQKVVNALFTSTNQLGLKTDVTDYHIDQVSNLVACLSDEFCLDEKRELSEKVKHAKRLSDERNLLQDPNFRGINRQPDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGEKCAHHSHHFSLDIDVGCTDLNEDLGVWVIFKIKTQDGHARLGNLEFLEEKPLLGEALARVKRAEKKWRDKRETLQLETTIVYKEAKESVDALFVNSQYDRLQADTNIAMIHAADKRVHRIREAYLPELSVIPGVNAAIFEELEERIFTAFSLYDARNIIKNGDFNNGLLCWNVKGHVEVEEQNNHRSVLVIPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 14 - DNA, 3690 bp, Artificial
  Recombinant nucleotide sequence used for expression in a bacterial cell encoding TIC867_21.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccggaacgacaacctatgagtatgaagagaagcagaatctagaaaaagcgcagaaagcgttgaacgctttgtttacggatggcacgaatggctatctacaaatggatgccactgattatgatatcaatcaaactgcaaacttaatagaatgtgtatcagatgaattgtatgcaaaagaaaagatagttttattagatgaagtcaaatatgcgaagcggcttagcatatcacgtaacctacttttgaacgatgatttagaattttcagatggatttggagaaaacggatggacgacaagtgataatatttcaatccaggcggataatcccctttttaaggggaattatttaaaaatgtttggggcaagagatattgatggaaccctatttccaacttatctctatcaaaaaatagatgagtccaggttaaaaccatatacacgttatcgagtaagagggtttgtgggaagtagtaaaaatctaaaattagtggtaacacgctatgagaaagaaattgatgccattatgaatgttccaaatgatttggcacatatgcagcttaacccttcatgtggagattatcgctgtgaatcatcgtcccagtttttggtgaaccaagtgcatcctacaccaacagctggatatgctcttgatatgtatgcatgcccgtcaagttcagataaaaaacatattatgtgtcacgatcgtcatccatttgattttcatattgacaccggagaattaaatccaaacacaaacctgggtattgatgtcttgtttaaaatttctaatccaaatggatacgctacattagggaatctagaagtcattgaagaaggaccactaacagatgaagcattggtacatgtaaaacaaaaggaaaagaaatggcgtcagcacatggagaaaaaacgaatggaaacacaacaagcctatgatccagcaaaacaagctgtagatgcattatttacaaatgaacaagagttagactatcatactactttagatcatattcagaacgccgatcagctggtacaggcgattccctatgtacaccatgcttggttaccggatgctccaggtatgaactatgatgtatatcaagggttaaacgcacgtatcatgcaggcgtacaatttatatgatgcacgaaatgtcataataaatggtgactttacacaaggactacaaggatggcacgcaacaggaaaagcagcggtacaacaaatagatggagcttcagtattagttctatcaaactggagtgccgaggtatctcagaatctgcatgcccaagatcatcatggatatatgttacgtgtgattgccaaaaaagaaggtcctggaaaagggtatgtaatgatgatggattttaatggaaagcaggaaacacttacgttcacttcttgtgaagaaggatatataacaaaaacaatagaggtattcccggaaagtgatcgaatacgaattgaaatgggagaaacagagggtacgttttatgtagatagcatcgagttgctttgtatgcaaggatatgctagcgataataacccgcacacgggtaatatgtatgagcaaagttataatggaaattataatcaaaatactagcgatgtgtatcaccaaggatatataaacaactataaccaaaattctagtagtatgtataatcaaaattatattaacaatgatgacctgcattccggttgcacatgtaaccaagggcataactctggctgtacatgtaatcaaggatataaccgttag

SEQ ID NO: 15 - DNA, 3690 bp, Artificial
  Synthetic nucleotide sequence designed for expression in a plant cell encoding TIC867_21.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccgggactaccacctacgagtacgaggagaagcagaatctcgagaaggctcagaaggctctgaacgctctgttcactgacgggaccaacggctacctccagatggacgccactgactacgacatcaaccagacagctaacctgattgagtgtgtgagtgacgaactgtacgctaaggagaagatcgtactcctggacgaggtgaagtacgctaagcgcctgagcattagccgtaacctgctgctgaacgacgatctggagttcagcgacggctttggcgagaacggctggaccaccagcgacaacatctccatccaggccgacaatccactcttcaaaggcaactacctcaagatgttcggagccagggacatcgacggcaccctctttccgacctacctctaccagaagatcgacgagtcccgcctcaaaccctacacccgctacagggtgcgcggcttcgtgggcagcagcaagaacctcaagctcgtggtcacacggtatgagaaggagatcgacgccatcatgaacgtgcccaacgatctcgcccacatgcagctcaatccatcctgcggcgactaccggtgcgagtccagctcccagttcctcgtgaaccaggtgcaccctactccgaccgctggctatgccctggacatgtacgcctgccctagttcctccgacaagaagcacatcatgtgccacgaccgtcatccgttcgacttccacatcgacaccggcgaactgaacccgaacaccaacctgggcatcgacgtactgttcaagatttccaacccgaacgggtacgccaccttgggcaacctggaggtcatcgaagaaggcccgctgaccgacgaggccctggtccacgtcaaacagaaggagaagaagtggcggcagcacatggagaagaagcggatggagactcaacaagcctacgacccggccaagcaagctgtggacgctctgttcaccaacgagcaagagcttgactaccacactactcttgaccacatccagaatgctgaccagcttgtccaggctattccgtacgtccaccacgcttggctaccggacgctccagggatgaactacgatgtgtaccagggtctgaacgcgcggatcatgcaagcgtacaacctgtacgacgcgcgtaacgtcatcatcaacggtgacttcactcagggtcttcaaggttggcacgcgactggcaaagcggcagtccagcagattgatggtgcgtctgttcttgtgttgagcaactggtctgcggaggtttctcagaacctgcacgcacaggatcaccacggctacatgctgagggtgattgctaagaaggagggccctggcaaaggctacgtcatgatgatggacttcaacggaaagcaagaaaccctgaccttcactagctgtgaggagggctacatcactaagaccattgaggtctttccggagtctgaccgcatccggatcgagatgggcgagaccgaaggcacgttctacgtggactccatcgaactcctctgcatgcaaggctacgcctccgacaacaacccacacacgggcaacatgtacgagcagtcctacaacgggaactacaaccagaacacctccgatgtgtaccatcagggctacatcaacaactacaaccagaacagcagcagcatgtacaaccagaactacatcaacaacgatgacttgcactcgggttgcacctgcaaccagggtcacaacagtgggtgcacgtgcaaccagggatacaaccgttga

SEQ ID NO: 16 - protein, 1229 aa, Artificial
  Amino acid sequence of the chimeric protein variant TIC867_21.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATGTTTYEYEEKQNLEKAQKALNALFTDGTNGYLQMDATDYDINQTANLIECVSDELYAKEKIVLLDEVKYAKRLSISRNLLLNDDLEFSDGFGENGWTTSDNISIQADNPLFKGNYLKMFGARDIDGTLFPTYLYQKIDESRLKPYTRYRVRGFVGSSKNLKLVVTRYEKEIDAIMNVPNDLAHMQLNPSCGDYRCESSSQFLVNQVHPTPTAGYALDMYACPSSSDKKHIMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELDYHTTLDHIQNADQLVQAIPYVHHAWLPDAPGMNYDVYQGLNARIMQAYNLYDARNVIINGDFTQGLQGWHATGKAAVQQIDGASVLVLSNWSAEVSQNLHAQDHHGYMLRVIAKKEGPGKGYVMMMDFNGKQETLTFTSCEEGYITKTIEVFPESDRIRIEMGETEGTFYVDSIELLCMQGYASDNNPHTGNMYEQSYNGNYNQNTSDVYHQGYINNYNQNSSSMYNQNYINNDDLHSGCTCNQGHNSGCTCNQGYNR

SEQ ID NO: 17 - DNA, 3432 bp, Artificial
  Recombinant nucleotide sequence used for expression in a bacterial cell encoding TIC867_22.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccaatccgacgcgagaggcggaagaggatctagaagcagcgaagaaagcggtggcgagcttgtttacacgtacaagggacggattacaagtaaatgtgacagattatcaagtcgatcaagcggcaaatttagtgtcatgcttatcagatgaacaatatgggcatgacaaaaagatgttattggaagcggtaagagcggcaaaacgcctcagccgagaacgcaacttacttcaggatccagattttaatacaatcaatagtacagaagaaaatggatggaaagcaagtaacggcgttactattagcgagggcggtccattctataaaggccgtgcgcttcagctagcaagcgcaagagaaaattacccaacatacatttatcaaaaagtaaatgcatcagagttaaagccgtatacacgttatagactggatgggttcgtgaagagtagtcaagatttagaaattgatctcattcaccatcataaagtccatctcgtgaaaaatgtaccagataatttagtatccgatacttactcggatggttcttgcagtggaatgaatcgatgtgaggaacaacagatggtaaatgcgcaactggaaacagaacatcatcatccgatggattgctgtgaagcggctcaaacacatgagttttcttcctatattaatacaggcgatctaaattcaagtgtagatcaaggcatttgggttgtattgaaagttcgaacaaccgatggttatgcgacgctaggaaatcttgaattggtagaggtcggaccgttatcgggtgaatctctagaacgtgaacaaagggataatgcgaaatggagtgcagagctaggaagaaagcgtgcagaaacagatcgcgtgtatcaagatgccaaacaatccatcaatcatttatttgtggattatcaagatcaacaattaaatccagaaatagggatggcagatattattgacgctcaaaatcttgtcgcatcaatttcagatgtgtatagcgatgcagtactgcaaatccctggaattaactatgagatttacacagagctatccaatcgcttacaacaagcatcgtatctgtatacgtctcgaaatgcggtgcaaaatggggactttaacagcggtctagatagttggaatgcaacagggggggctacggtacaacaggatggcaatacgcatttcttagttctttctcattgggatgcacaagtttctcaacaatttagagtgcagccgaattgtaaatatgtattacgtgtaacagcagagaaagtaggcggcggagacggatacgtgacaatccgggatggtgctcatcatacagaaaagcttacatttaatgcatgtgattatgatataaatggcacgtacgtgactgataatacgtatctaacaaaagaagtggtattctattcacatacagaacacatgtgggtagaggtaagtgaaacagaaggtgcatttcatatagatagtattgaattcgttgaaacagaaaagtag

SEQ ID NO: 18 - DNA, 3432 bp, Artificial
  Synthetic nucleotide sequence designed for expression in a plant cell encoding TIC867_22.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccaacccgacgcgggaagctgaggaagacttggaagccgccaagaaagcggtcgccagcctgtttactcggacgcgggacgggctccaagtgaatgtgacggactatcaagtggatcaggccgctaacctcgtgtcatgcctgagcgacgagcagtacggtcacgacaagaaaatgctgctggaggccgtccgggccgccaagcggctgtccagggagcgtaacctgctacaagatcccgactttaacacgatcaacagcacagaggagaatggctggaaggccagcaacggagttacgataagcgagggcggtccgttctacaagggtcgtgccctccagctcgcctctgcaagggagaactatccaacctacatctatcagaaggtgaacgcatccgagcttaagccctacacacgctaccgcctggacgggttcgttaagtccagtcaagacctagagatagacctcatccaccaccacaaagtgcatctggtcaagaacgttcccgataatctcgtgagcgatacctactcagacggctcatgctctggcatgaacagatgtgaggagcaacagatggttaatgctcaactcgaaaccgagcatcatcatcctatggattgctgcgaggccgcgcagacccatgagttcagctcttacatcaacaccggagacctcaacagtagcgtggatcagggaatttgggtggtgcttaaagtgcgtacaaccgacggctacgccaccctcggcaaccttgagcttgtcgaggtcggaccacttagcggcgagtccctggaacgtgagcagcgggacaacgccaaatggagcgcagagctagggcgcaaacgcgcggagacggaccgggtttatcaggacgcgaagcagtccatcaatcacctcttcgtggattatcaggaccagcagcttaatccagagatcggcatggccgacatcatcgacgcccagaacctagtagcgtcgatttccgatgtctattccgacgccgtgcttcaaatacctggcatcaactacgagatctacacagagttgtccaacaggctccagcaagcgtcatacctctacaccagccgcaacgccgtccagaatggcgacttcaattccggactagactcctggaacgccacgggcggagctacggtgcaacaagacggcaacacccacttcctcgtacttagccactgggacgctcaagtgagtcagcaattccgggttcagccgaactgcaagtacgtcctgcgcgtaacggccgagaaggttggaggcggagacggctacgttaccatccgcgacggcgctcaccacaccgagaaactgacgttcaacgcttgtgactacgacatcaacggcacttacgtgacggacaacacctacctgacgaaggaggtggtgttctattctcacaccgagcacatgtgggttgaggtcagcgagaccgagggagccttccacattgacagcatcgagttcgtggagactgagaagtga

SEQ ID NO: 19 - protein, 1143 aa, Artificial
  Amino acid sequence of the chimeric protein variant TIC867_22.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATNPTREAEEDLEAAKKAVASLFTRTRDGLQVNVTDYQVDQAANLVSCLSDEQYGHDKKMLLEAVRAAKRLSRERNLLQDPDFNTINSTEENGWKASNGVTISEGGPFYKGRALQLASARENYPTYIYQKVNASELKPYTRYRLDGFVKSSQDLEIDLIHHHKVHLVKNVPDNLVSDTYSDGSCSGMNRCEEQQMVNAQLETEHHHPMDCCEAAQTHEFSSYINTGDLNSSVDQGIWVVLKVRTTDGYATLGNLELVEVGPLSGESLEREQRDNAKWSAELGRKRAETDRVYQDAKQSINHLFVDYQDQQLNPEIGMADIIDAQNLVASISDVYSDAVLQIPGINYEIYTELSNRLQQASYLYTSRNAVQNGDFNSGLDSWNATGGATVQQDGNTHFLVLSHWDAQVSQQFRVQPNCKYVLRVTAEKVGGGDGYVTIRDGAHHTEKLTFNACDYDINGTYVTDNTYLTKEVVFYSHTEHMWVEVSETEGAFHIDSIEFVETEK

SEQ ID NO: 20 - DNA, 3696 bp, Artificial
  Synthetic nucleotide sequence designed for expression in a plant cell encoding TIC867_23.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccacggcgaccttcgaggcggagtatgacttggagcgggctcaggaggccgtcaacgcgctgttcacaaacaccaatcctcgccgcctcaagacgggtgtgactgattaccacattgacgaggtctccaacttggtcgcgtgtctgtccgatgagttctgcctggacgagaagcgggaactgctggagaaggtcaagtacgccaagcgcctctccgacgaaaggaacctcctccaagatcccaactttacttccattaacaagcagccggacttcatctccaccaacgagcagtccaacttcacctcaatccacgagcagtcggagcacgggtggtggggcagcgagaacatcaccatccaagagggcaacgacgtcttcaaggagaactacgtgatcctgcccggcaccttcaacgagtgttacccgacctatctctaccagaagattggcgaagcggaactcaaggcttacacccgttaccaactgagtggctacattgaggactcacaagacctggaaatctacctgatccgctacaacgccaagcacgagaccctcgacgtgcctggcacggagtccgtctggcccttgagcgtggagtctcctatcggtcgttgcggcgagcccaatcgctgcgctccgcactttgagtggaatcctgatttggattgctcctgccgagacggtgagaaatgcgcccaccactcgcaccacttcagcctagacatcgacgtgggctgcatcgacctgcacgagaacttgggcgtctgggtcgtgttcaagatcaagacacaggagggccatgctcggcttgggaacctggagttcatcgaggagaagccactgctgggtgaagccttgtcacgggtgaaacgcgccgagaagaagtggcgggacaaacgggagaagctccagttggagacaaagcgtgtgtacacagaggccaaggaggccgtggatgccttgttcgtggacagtcagtacgacaggctgcaagcggacaccaacatcgggatgatccacgcggctgataagcttgttcacagaatccgcgaggcgtacctgtcagagcttagcgtgatcccaggcgtcaacgccgaaatcttcgaggaactggagggccgcattatcacggcaatctcactttatgacgcgaggaatgtggtcaagaacggtgacttcaacaacggcttggcgtgttggaacgttaaagggcacgtggatgtacaacagtcacaccacagaagtgtcttggtcatcccggagtgggaggcggaagtgagccaggccgtccgggtctgccctgggcgcggttacatcctccgcgtgacagcgtacaaggagggctacggtgagggctgcgtgacgatccacgagattgagaacaacacggacgagcttaagttcaagaactgcgaggaggaggaagtgtacccgacagacaccggcacctgcaacgactacaccgcccaccaagggaccgccgcctgcaacagccgcaacgcgggctatgaagatgcgtacgaggttgataccaccgcctcagtgaactacaaaccgacttatgaggaggagacatacacggacgtcaggcgcgacaaccattgtgagtacgaccgtggctacgtgaactatccgccggtgccagcgggctacatgacgaaggagctagaatacttccctgagacggacaaggtgtggattgaaatcggcgagaccgagggcaagtttatcgtggattctgtcgagctgctgctaatggaggagtag

SEQ ID NO: 21 - protein, 1231 aa, Artificial
  Amino acid sequence of the chimeric protein variant TIC867_23.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATTATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVILPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 22 - DNA, 3666 bp, Artificial
  Synthetic nucleotide sequence designed for expression in a plant cell encoding TIC867_24.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccaccgcgacgtttgaagctgaatccgacctcgagcgtgcgcgcaaggcggtgaacgctctgttcacgagcaccaaccctcgtggcttgaagacggatgtgacggactaccacatcgaccaagtctcgaacctcgtggagtgcctgagcgacgagttctgtcttgacaagaagcgcgagctgctggaggaggtgaagtacgccaagcgcctctccgatgagcgcaacctgctccaagatcctaccttcacgtcgatttccggccaaaccgaccgtggatggatcggctcgactggcatctccatccagggcggcgacgacatcttcaaggagaactatgttcggctgccgggcacggtggacgagtgttacccgacgtacctctaccagaagatagacgagagtcaactcaagtcctacacgcggtatcagttacgtggctacattgaagactcccaggacttggaaatctatctcatacggtacaacgccaagcacgagaccttaagcgtgccgggaacggagtcgccctggccaagctctggcgtgtacccttccggtaggtgcggcgagcccaaccgctgtgcacctcgaatcgaatggaacccggaccttgactgctcttgccggtacggcgagaagtgcgtccatcattctcaccacttcagcttggacattgacgtcggctgcaccgacctcaatgaagacctcggagtgtgggtcatcttcaagatcaagacacaggacgggcacgcgaaactaggaaacctggagttcatcgaggagaagccactcctcggcaaggcactttccagggtcaagcgggccgagaagaaatggagggacaagtacgagaaactccagctcgaaacaaagcgggtgtacacggaggcaaaggaatccgtggacgccctgttcgtggactctcagtacgacaagctccaggcgaacacaaacattggcatcatccacggtgcggacaagcaagtgcacaggatacgggagccttacctctcggagctgccggtgattccctcgatcaacgcggcgatcttcgaggaactggagggccacatcttcaaggcgtattctctgtacgacgcgcgtaacgtcatcaagaacggcgacttcaacaatgggctgtcctgctggaacgttaaaggccacgtcgatgtccagcagaaccaccataggtcagtcctggtgctgagcgagtgggaggcggaggtgtcccagaaggtgcgcgtgtgcccggatcgcggctacatcttgagggtgacagcctacaaggagggctacggcgagggctgtgtcacgatccatgagttcgaggacaacacggatgtcctgaaattccgtaacttcgtcgaggaggaggtctatcccaacaacaccgtgacctgcaacgactacacgaccaatcagtcggctgagggcagtaccgatgcctgcaacagctacaaccgtggttacgaagatggatacgagaaccgctacgagcccaatccttcggctcccgtgaattacactcccacgtacgaggagggcatgtacactgacactcagggctacaaccattgcgtcagcgaccgtggctaccgcaaccacacgccgctcccagcgggctacgtgacgctggagctggaatactttcccgagacagaacaagtgtggatagagatcggcgagaccgagggcacattcatcgtgggctctgtggaattgctcctcatggaggagtaa

SEQ ID NO: 23 - protein, 1221 aa, Artificial
  Amino acid sequence of the chimeric protein variant TIC867_24.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATTATFEAESDLERARKAVNALFTSTNPRGLKTDVTDYHIDQVSNLVECLSDEFCLDKKRELLEEVKYAKRLSDERNLLQDPTFTSISGQTDRGWIGSTGISIQGGDDIFKENYVRLPGTVDECYPTYLYQKIDESQLKSYTRYQLRGYIEDSQDLEIYLIRYNAKHETLSVPGTESPWPSSGVYPSGRCGEPNRCAPRIEWNPDLDCSCRYGEKCVHHSHHFSLDIDVGCTDLNEDLGVWVIFKIKTQDGHAKLGNLEFIEEKPLLGKALSRVKRAEKKWRDKYEKLQLETKRVYTEAKESVDALFVDSQYDKLQANTNIGIIHGADKQVHRIREPYLSELPVIPSINAAIFEELEGHIFKAYSLYDARNVIKNGDFNNGLSCWNVKGHVDVQQNHHRSVLVLSEWEAEVSQKVRVCPDRGYILRVTAYKEGYGEGCVTIHEFEDNTDVLKFRNFVEEEVYPNNTVTCNDYTTNQSAEGSTDACNSYNRGYEDGYENRYEPNPSAPVNYTPTYEEGMYTDTQGYNHCVSDRGYRNHTPLPAGYVTLELEYFPETEQVWIEIGETEGTFIVGSVELLLMEE

SEQ ID NO: 24 - DNA, 3651 bp, Artificial
  Synthetic nucleotide sequence designed for expression in a plant cell encoding TIC867_25.
atgaccagcaaccgaaagaacgagaacgagatcatcaacgccctgtccataccggccgtgtcaaaccactccgcccagatgaacctctccaccgacgcgaggatcgaggactccctctgcatcgccgagggcaacaacatcgacccgttcgtgtctgcaagcacggtccagaccggcatcaacatcgcgggccgcatcctgggcgtgctcggcgtgcccttcgcgggtcaaatcgcctctttctactcattcctcgtgggcgagctgtggccgcgcggacgtgacccgtgggaaatcttcctggagcacgttgagcagctcatccggcagcaagtgaccgagaacaccagggacaccgcactggcacggctccagggccttggcaacagcttccgcgcctaccagcagtcgctggaggactggctggagaaccgagacgacgccagaacccgctcagttctgtacacacagtacatcgccctagagctggacttcctcaacgctatgccgctcttcgccatccgtaaccaggaagtaccgcttctgatggtgtacgcacaagcagcgaacctccatctgctcctgctgcgagacgcatctctgttcggcagtgagttcgggctgacgagccaggagatccagcgctactacgagcgccaagtggagaagactcgtgagtacagcgactactgcgcgcgctggtacaacacgggcttgaacaaccttcgcgggacaaacgccgaatcctggcttcgctacaaccagttccgccgcgacctcacgctgggtgtgctggacctggtcgcgctcttcccgtcctacgacacacgggtgtacccaatgaacacgagcgcacagctcacccgtgagatctacacagatcccatcggccgcaccaacgctcccagtggcttcgcaagcacgaattggttcaacaataacgctccttctttctctgccatcgaggccgctgtcatcagaccgccgcacttactcgatttcccggagcagctcactatcttctctgtgttgtcccggtggtcgaacacgcagtacatgaactactgggtgggccacaggctagagagccggaccatccgtggcagtctctcaacctcgacccacggcaacacgaacacgagcatcaaccctgtcactctccagtttacatctagggacgtttacaggacagagtcgttcgctggcattaacattctgttgaccactccggtgaacggcgtcccttgggcccgcttcaactggaggaatcctctgaactcactgcgcggcagccttctctacactatcggctacaccggcgttgggacgcaactcttcgactcggagaccgagctgccgcccgagaccaccgagcggcctaactacgagagttattcacacaggctctccaacatccgcttgatttctgggaacaccttgcgggctccggtgtactcctggacgcaccgcagcgccgacagaactaataccatcagctccgactcgatcacccagatcccgctggtgaaggctcacacgcttcagtcgggcaccacagtcgtcaagggccctggcttcaccggcggcgacatcctgcgtcgcacatctggcggacccttcgccttcagcaacgtgaacttggacttcaatttgtcacagcggtatcgtgccagaatccggtacgccagcactacgaacctgcgaatctatgttactgtggcgggcgagcggatcttcgccgggcaattcgacaagacgatggacgcgggagcacctctgacattccagtcattctcttacgccacgatcaacacggcattcacgtttccggagcgttccagtagcctgaccgtgggcgctgataccttcagtagcgggaacgaggtgtacgttgaccgtttcgagctgatcccggtcaccgccaccgatgctacctttgaagcagagtccgacttggaacgtgcacagaaggcagtgaacgcactcttcacctcaagcaaccagatcggattgaagacagatgtgacagattaccacatcgaccaagtgagcaacttggtggattgcttgtcagatgagttctgcttggatgagaagcgtgaactctccgagaaggtgaagcacgcaaagcgtctctcagatgaacgtaatctccttcaagaccctaactttcgtggtatcaatcgtcagccagatcgtggatggcgtggatcaacagacatcaccatccagggaggcgatgatgtgttcaaggagaactacgtgaccctcccaggaaccgtggatgaatgctacccaacctacctctaccagaagatcgacgagtcaaagctcaaggcttacacccgttatgaactccgtggctacatcgaagatagccaggatctcgaaatctatctcatccgttacaatgctaagcacgaaatcgtgaatgtgccaggaaccggctcactctggccactctcagcacagtcaccaatcggcaagtgcggcgaacccaatcgctgcgctcctcatctcgaatggaatcccgatctcgactgctcctgccgagacggcgagaagtgtgcacatcactcacaccacttcaccctcgacatcgacgtgggctgcaccgacctcaatgaagacctgggcgtgtgggtgatcttcaagatcaagacccaggacggccacgcacgactgggcaatctggagtttctggaggagaagccactgcttggcgaggcactggcacgagtgaaacgagccgagaagaaatggcgagacaaacgtgagaagctgcaactggagaccaacatcgtgtacaaagaggccaaagagtcagttgacgccctgtttgtcaatagccagtatgaccgactgcaagttgacaccaacatcgccatgatccacgctgcggacaagcgcgtccaccgcatccgcgaggcttatctgcccgagctgagcgtcattcccggcgtcaatgccgcgatcttcgaggagttagagggccgcatcttcaccgcctacagcctctatgacgcccgcaatgtcattaagaatggcgacttcaacaatggcttactatgctggaatgtcaaagggcacgttgacgtcgaggagcagaacaatcaccgcagcgtcttagtcatacccgagtgggaggccgaagtcagccaggaagtccgcgtctgtccagggcgcgggtacatcctgcgggtcaccgcctacaaagagggatacggcgagggttgtgtcaccatacacgagatagaggacaataccgacgaactcaagttcagcaattgtgtcgaggaggaagtctatcccaacaataccgtaacctgcaacaactacaccggaacccaggaggagtatgaagggacgtacacctcgcggaaccagggctatgacgaagcctatgggaacaacccgtcggtgcctgctgactatgcgtcggtctatgaggagaaatcgtacacggacgggcggcgggagaatccgtgtgagtcgaatcgcgggtatggtgactacacgccgctaccggcgggctatgtaacgaaagacctggaatacttcccggagacggacaaagtatggatagagataggcgagacggagggaacgttcatcgtggactcggtagagctgctgctcatggaggagtga

SEQ ID NO: 25 - protein, 1216 aa, Artificial
  Amino acid sequence of the chimeric protein variant TIC867_25.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATDATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 26 - DNA, 3600 bp, Artificial
  Recombinant nucleotide sequence used for expression in a bacterial cell encoding TIC868.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 27 - DNA, 3600 bp, Artificial
  Synthetic nucleotide sequence designed for expression in a plant cell encoding TIC868.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgttcgaggccgagtctgacctggagcgggctcagaaggctgtcaacgaactgttcaccagcagcaaccagattgggctcaagaccgacgtcacggactatcacattgaccaagtgtccaaccttgtggagtgcctgtccgacgagttctgcctcgacgagaagaaggagctgtccgagaaggtcaaacacgcgaagcgtctgagtgacgagcggaatttgctccaggacccgaacttccgtggcatcaaccgccagctcgaccgtggttggcgcgggagtacagacatcaccatccagggaggcgacgatgtgttcaaggagaactatgtgacgctgctcgggactttcgacgaatgctacccgacgtatctctaccagaagatagacgagagtaaattgaaggcgtacacccgctaccagcttcgcgggtacatcgaggatagtcaggacctggaaatctacctgatccgatacaacgccaagcacgagacagtgaacgtgccaggcacgggctcactttggccattgagcgctccctctccaatcggaaagtgcgctcaccactcgcaccacttctctctggacatcgacgtgggctgcaccgacctcaacgaggacctgggtgtctgggttatcttcaagattaagacccaggacggacatgcccgcctcggcaacctggagttccttgaggagaagcctctcgtgggcgaggccctcgctcgtgtgaagcgcgccgagaagaaatggcgagacaagcgggagaagctggagtgggagaccaacatcgtgtacaaggaggccaaggagtcagtggacgcactcttcgtcaacagccagtacgaccgcctccaggctgacaccaacatcgccatgatccacgcggctgacaagcgggtccacagcatccgtgaggcgtacctgcccgagctgtcagtgatccctggtgtgaacgcggcgatcttcgaggaactggagggccgcatcttcacagcattcagcctgtacgatgccaggaatgttattaagaacggtgacttcaacaacgggctgagttgctggaacgtcaagggccatgtggacgtcgaggagcagaacaaccaccggtccgtgctggtcgtgccggagtgggaggcagaggtgagccaggaggtccgcgtctgccctggtcgcggctacatcctccgtgtgactgcgtacaaggaaggctacggtgaaggctgcgtgactatccacgagatcgagaacaacaccgacgagctcaagttctcgaactgtgtggaggaggaggtgtacccgaacaacaccgttacttgcaacgactacactgccacgcaagaggagtacgagggcacttacacttcccggaatcgcggctatgatggcgcgtacgagtccaacagcagcgtgcctgcggattatgcgtccgcttacgaggagaaggcgtacaccgacggacggagggacaacccttgcgagtccaaccgtggctacggtgactacactccgctgcccgccgggtacgtcaccaaggagctggagtacttcccggagaccgacaaagtctggatcgagatcggcgagacggagggcactttcatcgtggactcggtcgagctgctactgatggaggagtga

SEQ ID NO: 28 - protein, 1199 aa, Artificial
  Amino acid sequence of the chimeric protein TIC868.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 29 - DNA, 3600 bp, Artificial
  Synthetic nucleotide sequence designed for expression in a plant cell encoding TIC868_9.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacagcctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgcaggcgggcattaacatccttatgacaacgcccgtcaacggcgtcccgtgggcccggttcaactggcgtaacccgaagaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgttcgaggccgagtctgacctggagcgggctcagaaggctgtcaacgaactgttcaccagcagcaaccagattgggctcaagaccgacgtcacggactatcacattgaccaagtgtccaaccttgtggagtgcctgtccgacgagttctgcctcgacgagaagaaggagctgtccgagaaggtcaaacacgcgaagcgtctgagtgacgagcggaatttgctccaggacccgaacttccgtggcatcaaccgccagctcgaccgtggttggcgcgggagtacagacatcaccatccagggaggcgacgatgtgttcaaggagaactatgtgacgctgctcgggactttcgacgaatgctacccgacgtatctctaccagaagatagacgagagtaaattgaaggcgtacacccgctaccagcttcgcgggtacatcgaggatagtcaggacctggaaatctacctgatccgatacaacgccaagcacgagacagtgaacgtgccaggcacgggctcactttggccattgagcgctccctctccaatcggaaagtgcgctcaccactcgcaccacttctctctggacatcgacgtgggctgcaccgacctcaacgaggacctgggtgtctgggttatcttcaagattaagacccaggacggacatgcccgcctcggcaacctggagttccttgaggagaagcctctcgtgggcgaggccctcgctcgtgtgaagcgcgccgagaagaaatggcgagacaagcgggagaagctggagtgggagaccaacatcgtgtacaaggaggccaaggagtcagtggacgcactcttcgtcaacagccagtacgaccgcctccaggctgacaccaacatcgccatgatccacgcggctgacaagcgggtccacagcatccgtgaggcgtacctgcccgagctgtcagtgatccctggtgtgaacgcggcgatcttcgaggaactggagggccgcatcttcacagcattcagcctgtacgatgccaggaatgttattaagaacggtgacttcaacaacgggctgagttgctggaacgtcaagggccatgtggacgtcgaggagcagaacaaccaccggtccgtgctggtcgtgccggagtgggaggcagaggtgagccaggaggtccgcgtctgccctggtcgcggctacatcctccgtgtgactgcgtacaaggaaggctacggtgaaggctgcgtgactatccacgagatcgagaacaacaccgacgagctcaagttctcgaactgtgtggaggaggaggtgtacccgaacaacaccgttacttgcaacgactacactgccacgcaagaggagtacgagggcacttacacttcccggaatcgcggctatgatggcgcgtacgagtccaacagcagcgtgcctgcggattatgcgtccgcttacgaggagaaggcgtacaccgacggacggagggacaacccttgcgagtccaaccgtggctacggtgactacactccgctgcccgccgggtacgtcaccaaggagctggagtacttcccggagaccgacaaagtctggatcgagatcggcgagacggagggcactttcatcgtggactcggtcgagctgctactgatggaggagtga

SEQ ID NO: 30 - protein, 1199 aa, Artificial
  Amino acid sequence of the chimeric protein variant TIC868_9.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNSLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESQAGINILMTTPVNGVPWARFNWRNPKNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 31 - DNA, 3678 bp, Artificial
  Recombinant nucleotide sequence used for expression in a bacterial cell encoding TIC868_10.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaggcagaatatgatttagaaagagcgcaaaaggtggtgaatgccctgtttacgtctacaaaccaactagggctaaaaacagatgtgacggattatcatattgatcaggtatccaatctagttgcgtgtttatcggatgaattttgtctggatgaaaagagagaattgtccgagaaagttaaacatgcaaagcgactcagtgatgagcggaatttacttcaagatccaaacttcagagggatcaataggcaaccagaccgtggctggagaggaagtacggatattactatccaaggaggagatgacgtattcaaagagaattacgttacgctaccgggtacctttgatgagtgctatccaacgtatttatatcaaaaaatagatgagtcgaaattaaaagcctatacccgttatcaattaagagggtatatcgaagatagtcaagacttagaaatctatttaattcgttacaatgcaaaacacgaaatagtaaatgtaccaggtacaggaagtttatggcctctttctgtagaaaatcaaattggaccttgtggagaaccgaatcgatgcgcgccacaccttgaatggaatcctgatttacactgttcctgcagagacggggaaaaatgtgcacatcattctcatcatttctctttggacattgatgttggatgtacagacttaaatgaggacttaggtgtatgggtgatattcaagattaagacgcaagatggccacgcacgactagggaatctagagtttctcgaagagaaaccattattaggagaagcactagctcgtgtgaaaagagcggagaaaaaatggagagacaaacgcgaaacattacaattggaaacaactatcgtttataaagaggcaaaagaatctgtagatgctttatttgtaaactctcaatatgatagattacaagcggatacgaacatcgcgatgattcatgcggcagataaacgcgttcatagaattcgagaagcgtatctgccggagctgtctgtgattccgggtgtcaatgcggctatttttgaagaattagaagagcgtattttcactgcattttccctatatgatgcgagaaatattattaaaaatggcgatttcaataatggcttattatgctggaacgtgaaagggcatgtagaggtagaagaacaaaacaatcaccgttcagtcctggttatcccagaatgggaggcagaagtgtcacaagaggttcgtgtctgtccaggtcgtggctatatccttcgtgttacagcgtacaaagagggatatggagaaggttgcgtaacgatccatgagatcgagaacaatacagacgaactgaaattcaacaactgtgtagaagaggaagtatatccaaacaacacggtaacgtgtattaattatactgcgactcaagaagaatatgagggtacgtacacttctcgtaatcgaggatatgacgaagcctatggtaataacccttccgtaccagctgattatgcgtcagtctatgaagaaaaatcgtatacagatagacgaagagagaatccttgtgaatctaacagaggatatggagattacacaccactaccagctggttatgtaacaaaggaattagagtacttcccagagaccgataaggtatggattgagattggagaaacagaaggaacattcatcgtggacagcgtggaattactccttatggaggaatag

SEQ ID NO: 32 - DNA, 3678 bp, Artificial
  Synthetic nucleotide sequence designed for expression in a plant cell encoding TIC868_10.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgttcgaggccgagtacgaccttgagcgcgcccagaaggtggtgaacgccctcttcactagcactaaccagctaggcctgaagactgacgtgaccgactaccacatcgaccaagtgagcaacctagtggcctgcctctccgacgagttctgcctcgacgagaagcgcgagctgtccgagaaggtgaagcacgccaagcgcctctccgacgagcgcaacctgctccaggaccccaacttcaggggcatcaacaggcagcccgaccgcggctggcgcggctccaccgacatcaccatccagggcggtgacgacgtattcaaggagaactacgttaccctccccggcaccttcgacgagtgttaccccacctacctctaccagaagatcgacgagtccaagctgaaggcctacacccgctaccagctccgcggctacatcgaggactcccaggacctggaaatctacctcatccgctacaacgccaagcacgagatcgtgaacgtgcctggcaccggcagcctctggcctctcagcgtggagaaccagatcggcccttgcggcgagcctaaccgctgcgcccctcacctcgagtggaaccctgacctccactgctcgtgcagggacggcgagaagtgcgcccaccatagccaccacttctctctggacatcgacgtgggctgcaccgacctgaacgaggacctgggcgtgtgggttatcttcaagatcaagacccaggacggtcacgccaggctgggtaacctggagttccttgaggaaaagcctctgctgggtgaggccctggccagggtcaagagggctgagaagaaatggagggataagagggagaccctgcagctggagaccactatcgtctacaaggaggctaaggagtctgtcgatgctctgttcgtcaactctcagtacgatagactgcaagctgataccaacatcgctatgatccacgctgcggataagcgggtccaccggatccgggaggcttaccttccggagctttctgtcatcccgggtgtcaacgctgcgatcttcgaggaacttgaggaacggatcttcactgcgtttagtctttacgatgcgcggaacatcatcaagaacggggacttcaacaatggtctgctgtgctggaacgtcaagggtcatgtcgaggtcgaggaacaaaacaatcatcgtagtgtccttgtcattcctgagtgggaggcggaggtctctcaagaggtccgtgtttgcccggggcgtgggtacattcttcgtgttactgcgtacaaggaggggtacggggaggggtgcgttactattcatgagattgagaacaatactgatgagcttaagttcaacaattgtgttgaggaggaggtttacccgaacaatactgttacgtgcatcaactacacggcaacgcaagaggaatacgaggggacgtacacctcgcgtaatagagggtatgatgaggcgtacggaaacaacccgtcggttccagcagattatgcctcggtttatgaggagaagtcgtacacggatagacgacgcgagaatccatgtgagtcaaatcgaggatacggagattacacaccattaccagcaggatacgttacaaaggagttggaatacttcccggaaacagataaagtttggattgaaatcggagaaacagaaggaacattcatcgtcgactcagtagaattgttgttgatggaagaatga

SEQ ID NO: 33 - protein, 1225 aa, Artificial
  Amino acid sequence of the chimeric protein variant TIC868_10.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAEYDLERAQKVVNALFTSTNQLGLKTDVTDYHIDQVSNLVACLSDEFCLDEKRELSEKVKHAKRLSDERNLLQDPNFRGINRQPDRGWRGSTDITIQGGDDVFKENYVTLPGTFDECYPTYLYQKIDESKLKAYTRYQLRGYIEDSQDLEIYLIRYNAKHEIVNVPGTGSLWPLSVENQIGPCGEPNRCAPHLEWNPDLHCSCRDGEKCAHHSHHFSLDIDVGCTDLNEDLGVWVIFKIKTQDGHARLGNLEFLEEKPLLGEALARVKRAEKKWRDKRETLQLETTIVYKEAKESVDALFVNSQYDRLQADTNIAMIHAADKRVHRIREAYLPELSVIPGVNAAIFEELEERIFTAFSLYDARNIIKNGDFNNGLLCWNVKGHVEVEEQNNHRSVLVIPEWEAEVSQEVRVCPGRGYILRVTAYKEGYGEGCVTIHEIENNTDELKFNNCVEEEVYPNNTVTCINYTATQEEYEGTYTSRNRGYDEAYGNNPSVPADYASVYEEKSYTDRRRENPCESNRGYGDYTPLPAGYVTKELEYFPETDKVWIEIGETEGTFIVDSVELLLMEE

SEQ ID NO: 34 - DNA, 3726 bp, Artificial
  Recombinant nucleotide sequence used for expression in a bacterial cell encoding TIC868_11.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacaggaacgacaacctatgagtatgaagagaagcagaatctagaaaaagcgcagaaagcgttgaacgctttgtttacggatggcacgaatggctatctacaaatggatgccactgattatgatatcaatcaaactgcaaacttaatagaatgtgtatcagatgaattgtatgcaaaagaaaagatagttttattagatgaagtcaaatatgcgaagcggcttagcatatcacgtaacctacttttgaacgatgatttagaattttcagatggatttggagaaaacggatggacgacaagtgataatatttcaatccaggcggataatcccctttttaaggggaattatttaaaaatgtttggggcaagagatattgatggaaccctatttccaacttatctctatcaaaaaatagatgagtccaggttaaaaccatatacacgttatcgagtaagagggtttgtgggaagtagtaaaaatctaaaattagtggtaacacgctatgagaaagaaattgatgccattatgaatgttccaaatgatttggcacatatgcagcttaacccttcatgtggagattatcgctgtgaatcatcgtcccagtttttggtgaaccaagtgcatcctacaccaacagctggatatgctcttgatatgtatgcatgcccgtcaagttcagataaaaaacatattatgtgtcacgatcgtcatccatttgattttcatattgacaccggagaattaaatccaaacacaaacctgggtattgatgtcttgtttaaaatttctaatccaaatggatacgctacattagggaatctagaagtcattgaagaaggaccactaacagatgaagcattggtacatgtaaaacaaaaggaaaagaaatggcgtcagcacatggagaaaaaacgaatggaaacacaacaagcctatgatccagcaaaacaagctgtagatgcattatttacaaatgaacaagagttagactatcatactactttagatcatattcagaacgccgatcagctggtacaggcgattccctatgtacaccatgcttggttaccggatgctccaggtatgaactatgatgtatatcaagggttaaacgcacgtatcatgcaggcgtacaatttatatgatgcacgaaatgtcataataaatggtgactttacacaaggactacaaggatggcacgcaacaggaaaagcagcggtacaacaaatagatggagcttcagtattagttctatcaaactggagtgccgaggtatctcagaatctgcatgcccaagatcatcatggatatatgttacgtgtgattgccaaaaaagaaggtcctggaaaagggtatgtaatgatgatggattttaatggaaagcaggaaacacttacgttcacttcttgtgaagaaggatatataacaaaaacaatagaggtattcccggaaagtgatcgaatacgaattgaaatgggagaaacagagggtacgttttatgtagatagcatcgagttgctttgtatgcaaggatatgctagcgataataacccgcacacgggtaatatgtatgagcaaagttataatggaaattataatcaaaatactagcgatgtgtatcaccaaggatatataaacaactataaccaaaattctagtagtatgtataatcaaaattatattaacaatgatgacctgcattccggttgcacatgtaaccaagggcataactctggctgtacatgtaatcaaggatataaccgttag

SEQ ID NO: 35 - DNA, 3726 bp, Artificial
  Synthetic nucleotide sequence designed for expression in a plant cell encoding TIC868_11.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacggggactaccacctacgagtacgaggagaagcagaatctcgagaaggctcagaaggctctgaacgctctgttcactgacgggaccaacggctacctccagatggacgccactgactacgacatcaaccagacagctaacctgattgagtgtgtgagtgacgaactgtacgctaaggagaagatcgtactcctggacgaggtgaagtacgctaagcgcctgagcattagccgtaacctgctgctgaacgacgatctggagttcagcgacggctttggcgagaacggctggaccaccagcgacaacatctccatccaggccgacaatccactcttcaaaggcaactacctcaagatgttcggagccagggacatcgacggcaccctctttccgacctacctctaccagaagatcgacgagtcccgcctcaaaccctacacccgctacagggtgcgcggcttcgtgggcagcagcaagaacctcaagctcgtggtcacacggtatgagaaggagatcgacgccatcatgaacgtgcccaacgatctcgcccacatgcagctcaatccatcctgcggcgactaccggtgcgagtccagctcccagttcctcgtgaaccaggtgcaccctactccgaccgctggctatgccctggacatgtacgcctgccctagttcctccgacaagaagcacatcatgtgccacgaccgtcatccgttcgacttccacatcgacaccggcgaactgaacccgaacaccaacctgggcatcgacgtactgttcaagatttccaacccgaacgggtacgccaccttgggcaacctggaggtcatcgaagaaggcccgctgaccgacgaggccctggtccacgtcaaacagaaggagaagaagtggcggcagcacatggagaagaagcggatggagactcaacaagcctacgacccggccaagcaagctgtggacgctctgttcaccaacgagcaagagcttgactaccacactactcttgaccacatccagaatgctgaccagcttgtccaggctattccgtacgtccaccacgcttggctaccggacgctccagggatgaactacgatgtgtaccagggtctgaacgcgcggatcatgcaagcgtacaacctgtacgacgcgcgtaacgtcatcatcaacggtgacttcactcagggtcttcaaggttggcacgcgactggcaaagcggcagtccagcagattgatggtgcgtctgttcttgtgttgagcaactggtctgcggaggtttctcagaacctgcacgcacaggatcaccacggctacatgctgagggtgattgctaagaaggagggccctggcaaaggctacgtcatgatgatggacttcaacggaaagcaagaaaccctgaccttcactagctgtgaggagggctacatcactaagaccattgaggtctttccggagtctgaccgcatccggatcgagatgggcgagaccgaaggcacgttctacgtggactccatcgaactcctctgcatgcaaggctacgcctccgacaacaacccacacacgggcaacatgtacgagcagtcctacaacgggaactacaaccagaacacctccgatgtgtaccatcagggctacatcaacaactacaaccagaacagcagcagcatgtacaaccagaactacatcaacaacgatgacttgcactcgggttgcacctgcaaccagggtcacaacagtgggtgcacgtgcaaccagggatacaaccgttga

SEQ ID NO: 36 - protein, 1241 aa, Artificial
  Amino acid sequence of the chimeric protein variant TIC868_11.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATGTTTYEYEEKQNLEKAQKALNALFTDGTNGYLQMDATDYDINQTANLIECVSDELYAKEKIVLLDEVKYAKRLSISRNLLLNDDLEFSDGFGENGWTTSDNISIQADNPLFKGNYLKMFGARDIDGTLFPTYLYQKIDESRLKPYTRYRVRGFVGSSKNLKLVVTRYEKEIDAIMNVPNDLAHMQLNPSCGDYRCESSSQFLVNQVHPTPTAGYALDMYACPSSSDKKHIMCHDRHPFDFHIDTGELNPNTNLGIDVLFKISNPNGYATLGNLEVIEEGPLTDEALVHVKQKEKKWRQHMEKKRMETQQAYDPAKQAVDALFTNEQELDYHTTLDHIQNADQLVQAIPYVHHAWLPDAPGMNYDVYQGLNARIMQAYNLYDARNVIINGDFTQGLQGWHATGKAAVQQIDGASVLVLSNWSAEVSQNLHAQDHHGYMLRVIAKKEGPGKGYVMMMDFNGKQETLTFTSCEEGYITKTIEVFPESDRIRIEMGETEGTFYVDSIELLCMQGYASDNNPHTGNMYEQSYNGNYNQNTSDVYHQGYINNYNQNSSSMYNQNYINNDDLHSGCTCNQGHNSGCTCNQGYNR

SEQ ID NO: 37 - DNA, 3468 bp, Artificial
  Recombinant nucleotide sequence used for expression in a bacterial cell encoding TIC868_12.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacaaatccgacgcgagaggcggaagaggatctagaagcagcgaagaaagcggtggcgagcttgtttacacgtacaagggacggattacaagtaaatgtgacagattatcaagtcgatcaagcggcaaatttagtgtcatgcttatcagatgaacaatatgggcatgacaaaaagatgttattggaagcggtaagagcggcaaaacgcctcagccgagaacgcaacttacttcaggatccagattttaatacaatcaatagtacagaagaaaatggatggaaagcaagtaacggcgttactattagcgagggcggtccattctataaaggccgtgcgcttcagctagcaagcgcaagagaaaattacccaacatacatttatcaaaaagtaaatgcatcagagttaaagccgtatacacgttatagactggatgggttcgtgaagagtagtcaagatttagaaattgatctcattcaccatcataaagtccatctcgtgaaaaatgtaccagataatttagtatccgatacttactcggatggttcttgcagtggaatgaatcgatgtgaggaacaacagatggtaaatgcgcaactggaaacagaacatcatcatccgatggattgctgtgaagcggctcaaacacatgagttttcttcctatattaatacaggcgatctaaattcaagtgtagatcaaggcatttgggttgtattgaaagttcgaacaaccgatggttatgcgacgctaggaaatcttgaattggtagaggtcggaccgttatcgggtgaatctctagaacgtgaacaaagggataatgcgaaatggagtgcagagctaggaagaaagcgtgcagaaacagatcgcgtgtatcaagatgccaaacaatccatcaatcatttatttgtggattatcaagatcaacaattaaatccagaaatagggatggcagatattattgacgctcaaaatcttgtcgcatcaatttcagatgtgtatagcgatgcagtactgcaaatccctggaattaactatgagatttacacagagctatccaatcgcttacaacaagcatcgtatctgtatacgtctcgaaatgcggtgcaaaatggggactttaacagcggtctagatagttggaatgcaacagggggggctacggtacaacaggatggcaatacgcatttcttagttctttctcattgggatgcacaagtttctcaacaatttagagtgcagccgaattgtaaatatgtattacgtgtaacagcagagaaagtaggcggcggagacggatacgtgacaatccgggatggtgctcatcatacagaaaagcttacatttaatgcatgtgattatgatataaatggcacgtacgtgactgataatacgtatctaacaaaagaagtggtattctattcacatacagaacacatgtgggtagaggtaagtgaaacagaaggtgcatttcatatagatagtattgaattcgttgaaacagaaaagtag

SEQ ID NO: 38 - DNA, 3468 bp, Artificial
  Synthetic nucleotide sequence designed for expression in a plant cell encoding TIC868_12.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgaacccgacgcgggaagctgaggaagacttggaagccgccaagaaagcggtcgccagcctgtttactcggacgcgggacgggctccaagtgaatgtgacggactatcaagtggatcaggccgctaacctcgtgtcatgcctgagcgacgagcagtacggtcacgacaagaaaatgctgctggaggccgtccgggccgccaagcggctgtccagggagcgtaacctgctacaagatcccgactttaacacgatcaacagcacagaggagaatggctggaaggccagcaacggagttacgataagcgagggcggtccgttctacaagggtcgtgccctccagctcgcctctgcaagggagaactatccaacctacatctatcagaaggtgaacgcatccgagcttaagccctacacacgctaccgcctggacgggttcgttaagtccagtcaagacctagagatagacctcatccaccaccacaaagtgcatctggtcaagaacgttcccgataatctcgtgagcgatacctactcagacggctcatgctctggcatgaacagatgtgaggagcaacagatggttaatgctcaactcgaaaccgagcatcatcatcctatggattgctgcgaggccgcgcagacccatgagttcagctcttacatcaacaccggagacctcaacagtagcgtggatcagggaatttgggtggtgcttaaagtgcgtacaaccgacggctacgccaccctcggcaaccttgagcttgtcgaggtcggaccacttagcggcgagtccctggaacgtgagcagcgggacaacgccaaatggagcgcagagctagggcgcaaacgcgcggagacggaccgggtttatcaggacgcgaagcagtccatcaatcacctcttcgtggattatcaggaccagcagcttaatccagagatcggcatggccgacatcatcgacgcccagaacctagtagcgtcgatttccgatgtctattccgacgccgtgcttcaaatacctggcatcaactacgagatctacacagagttgtccaacaggctccagcaagcgtcatacctctacaccagccgcaacgccgtccagaatggcgacttcaattccggactagactcctggaacgccacgggcggagctacggtgcaacaagacggcaacacccacttcctcgtacttagccactgggacgctcaagtgagtcagcaattccgggttcagccgaactgcaagtacgtcctgcgcgtaacggccgagaaggttggaggcggagacggctacgttaccatccgcgacggcgctcaccacaccgagaaactgacgttcaacgcttgtgactacgacatcaacggcacttacgtgacggacaacacctacctgacgaaggaggtggtgttctattctcacaccgagcacatgtgggttgaggtcagcgagaccgagggagccttccacattgacagcatcgagttcgtggagactgagaagtga

SEQ ID NO: 39 - protein, 1155 aa, Artificial
  Amino acid sequence of the chimeric protein variant TIC868_12.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATNPTREAEEDLEAAKKAVASLFTRTRDGLQVNVTDYQVDQAANLVSCLSDEQYGHDKKMLLEAVRAAKRLSRERNLLQDPDFNTINSTEENGWKASNGVTISEGGPFYKGRALQLASARENYPTYIYQKVNASELKPYTRYRLDGFVKSSQDLEIDLIHHHKVHLVKNVPDNLVSDTYSDGSCSGMNRCEEQQMVNAQLETEHHHPMDCCEAAQTHEFSSYINTGDLNSSVDQGIWVVLKVRTTDGYATLGNLELVEVGPLSGESLEREQRDNAKWSAELGRKRAETDRVYQDAKQSINHLFVDYQDQQLNPEIGMADIIDAQNLVASISDVYSDAVLQIPGINYEIYTELSNRLQQASYLYTSRNAVQNGDFNSGLDSWNATGGATVQQDGNTHFLVLSHWDAQVSQQFRVQPNCKYVLRVTAEKVGGGDGYVTIRDGAHHTEKLTFNACDYDINGTYVTDNTYLTKEVVFYSHTEHMWVEVSETEGAFHIDSIEFVETEK

SEQ ID NO: 40 - DNA, 3732 bp, Artificial
  Synthetic nucleotide sequence designed for expression in a plant cell encoding TIC868_13.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgacggcgaccttcgaggcggagtatgacttggagcgggctcaggaggccgtcaacgcgctgttcacaaacaccaatcctcgccgcctcaagacgggtgtgactgattaccacattgacgaggtctccaacttggtcgcgtgtctgtccgatgagttctgcctggacgagaagcgggaactgctggagaaggtcaagtacgccaagcgcctctccgacgaaaggaacctcctccaagatcccaactttacttccattaacaagcagccggacttcatctccaccaacgagcagtccaacttcacctcaatccacgagcagtcggagcacgggtggtggggcagcgagaacatcaccatccaagagggcaacgacgtcttcaaggagaactacgtgatcctgcccggcaccttcaacgagtgttacccgacctatctctaccagaagattggcgaagcggaactcaaggcttacacccgttaccaactgagtggctacattgaggactcacaagacctggaaatctacctgatccgctacaacgccaagcacgagaccctcgacgtgcctggcacggagtccgtctggcccttgagcgtggagtctcctatcggtcgttgcggcgagcccaatcgctgcgctccgcactttgagtggaatcctgatttggattgctcctgccgagacggtgagaaatgcgcccaccactcgcaccacttcagcctagacatcgacgtgggctgcatcgacctgcacgagaacttgggcgtctgggtcgtgttcaagatcaagacacaggagggccatgctcggcttgggaacctggagttcatcgaggagaagccactgctgggtgaagccttgtcacgggtgaaacgcgccgagaagaagtggcgggacaaacgggagaagctccagttggagacaaagcgtgtgtacacagaggccaaggaggccgtggatgccttgttcgtggacagtcagtacgacaggctgcaagcggacaccaacatcgggatgatccacgcggctgataagcttgttcacagaatccgcgaggcgtacctgtcagagcttagcgtgatcccaggcgtcaacgccgaaatcttcgaggaactggagggccgcattatcacggcaatctcactttatgacgcgaggaatgtggtcaagaacggtgacttcaacaacggcttggcgtgttggaacgttaaagggcacgtggatgtacaacagtcacaccacagaagtgtcttggtcatcccggagtgggaggcggaagtgagccaggccgtccgggtctgccctgggcgcggttacatcctccgcgtgacagcgtacaaggagggctacggtgagggctgcgtgacgatccacgagattgagaacaacacggacgagcttaagttcaagaactgcgaggaggaggaagtgtacccgacagacaccggcacctgcaacgactacaccgcccaccaagggaccgccgcctgcaacagccgcaacgcgggctatgaagatgcgtacgaggttgataccaccgcctcagtgaactacaaaccgacttatgaggaggagacatacacggacgtcaggcgcgacaaccattgtgagtacgaccgtggctacgtgaactatccgccggtgccagcgggctacatgacgaaggagctagaatacttccctgagacggacaaggtgtggattgaaatcggcgagaccgagggcaagtttatcgtggattctgtcgagctgctgctaatggaggagtag

SEQ ID NO: 41 - protein, 1243 aa, Artificial
  Amino acid sequence of the chimeric protein variant TIC868_13.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATTATFEAEYDLERAQEAVNALFTNTNPRRLKTGVTDYHIDEVSNLVACLSDEFCLDEKRELLEKVKYAKRLSDERNLLQDPNFTSINKQPDFISTNEQSNFTSIHEQSEHGWWGSENITIQEGNDVFKENYVILPGTFNECYPTYLYQKIGEAELKAYTRYQLSGYIEDSQDLEIYLIRYNAKHETLDVPGTESVWPLSVESPIGRCGEPNRCAPHFEWNPDLDCSCRDGEKCAHHSHHFSLDIDVGCIDLHENLGVWVVFKIKTQEGHARLGNLEFIEEKPLLGEALSRVKRAEKKWRDKREKLQLETKRVYTEAKEAVDALFVDSQYDRLQADTNIGMIHAADKLVHRIREAYLSELSVIPGVNAEIFEELEGRIITAISLYDARNVVKNGDFNNGLACWNVKGHVDVQQSHHRSVLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYMTKELEYFPETDKVWIEIGETEGKFIVDSVELLLMEE

SEQ ID NO: 42 - DNA, 3702 bp, Artificial
  Synthetic nucleotide sequence designed for expression in a plant cell encoding TIC868_14.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgaccgcgacgtttgaagctgaatccgacctcgagcgtgcgcgcaaggcggtgaacgctctgttcacgagcaccaaccctcgtggcttgaagacggatgtgacggactaccacatcgaccaagtctcgaacctcgtggagtgcctgagcgacgagttctgtcttgacaagaagcgcgagctgctggaggaggtgaagtacgccaagcgcctctccgatgagcgcaacctgctccaagatcctaccttcacgtcgatttccggccaaaccgaccgtggatggatcggctcgactggcatctccatccagggcggcgacgacatcttcaaggagaactatgttcggctgccgggcacggtggacgagtgttacccgacgtacctctaccagaagatagacgagagtcaactcaagtcctacacgcggtatcagttacgtggctacattgaagactcccaggacttggaaatctatctcatacggtacaacgccaagcacgagaccttaagcgtgccgggaacggagtcgccctggccaagctctggcgtgtacccttccggtaggtgcggcgagcccaaccgctgtgcacctcgaatcgaatggaacccggaccttgactgctcttgccggtacggcgagaagtgcgtccatcattctcaccacttcagcttggacattgacgtcggctgcaccgacctcaatgaagacctcggagtgtgggtcatcttcaagatcaagacacaggacgggcacgcgaaactaggaaacctggagttcatcgaggagaagccactcctcggcaaggcactttccagggtcaagcgggccgagaagaaatggagggacaagtacgagaaactccagctcgaaacaaagcgggtgtacacggaggcaaaggaatccgtggacgccctgttcgtggactctcagtacgacaagctccaggcgaacacaaacattggcatcatccacggtgcggacaagcaagtgcacaggatacgggagccttacctctcggagctgccggtgattccctcgatcaacgcggcgatcttcgaggaactggagggccacatcttcaaggcgtattctctgtacgacgcgcgtaacgtcatcaagaacggcgacttcaacaatgggctgtcctgctggaacgttaaaggccacgtcgatgtccagcagaaccaccataggtcagtcctggtgctgagcgagtgggaggcggaggtgtcccagaaggtgcgcgtgtgcccggatcgcggctacatcttgagggtgacagcctacaaggagggctacggcgagggctgtgtcacgatccatgagttcgaggacaacacggatgtcctgaaattccgtaacttcgtcgaggaggaggtctatcccaacaacaccgtgacctgcaacgactacacgaccaatcagtcggctgagggcagtaccgatgcctgcaacagctacaaccgtggttacgaagatggatacgagaaccgctacgagcccaatccttcggctcccgtgaattacactcccacgtacgaggagggcatgtacactgacactcagggctacaaccattgcgtcagcgaccgtggctaccgcaaccacacgccgctcccagcgggctacgtgacgctggagctggaatactttcccgagacagaacaagtgtggatagagatcggcgagaccgagggcacattcatcgtgggctctgtggaattgctcctcatggaggagtaa

SEQ ID NO: 43 - protein, 1200 aa, Artificial
  Amino acid sequence of the chimeric protein variant TIC868_14.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATTATFEAESDLERARKAVNALFTSTNPRGLKTDVTDYHIDQVSNLVECLSDEFCLDKKRELLEEVKYAKRLSDERNLLQDPTFTSISGQTDRGWIGSTGISIQGGDDIFKENYVRLPGTVDECYPTYLYQKIDESQLKSYTRYQLRGYIEDSQDLEIYLIRYNAKHETLSVPGTESPWPSSGVYPSGRCGEPNRCAPRIEWNPDLDCSCRYGEKCVHHSHHFSLDIDVGCTDLNEDLGVWVIFKIKTQDGHAKLGNLEFIEEKPLLGKALSRVKRAEKKWRDKYEKLQLETKRVYTEAKESVDALFVDSQYDKLQANTNIGIIHGADKQVHRIREPYLSELPVIPSINAAIFEELEGHIFKAYSLYDARNVIKNGDFNNGLSCWNVKGHVDVQQNHHRSVLVLSEWEAEVSQKVRVCPDRGYILRVTAYKEGYGEGCVTIHEFEDNTDVLKFRNFVEEEVYPNNTVTCNDYTTNQSAEGSTDACNSYNRGYEDGYENRYEPNPSAPVNYTPTYEEGMYTDTQGYNHCVSDRGYRNHTPLPAGYVTLE

SEQ ID NO: 44 - DNA, 3687 bp, Artificial
  Synthetic nucleotide sequence designed for expression in a plant cell encoding TIC868_15.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagcagtcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctccgtgctctcacgctggtccaacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacggatgctacctttgaagcagagtccgacttggaacgtgcacagaaggcagtgaacgcactcttcacctcaagcaaccagatcggattgaagacagatgtgacagattaccacatcgaccaagtgagcaacttggtggattgcttgtcagatgagttctgcttggatgagaagcgtgaactctccgagaaggtgaagcacgcaaagcgtctctcagatgaacgtaatctccttcaagaccctaactttcgtggtatcaatcgtcagccagatcgtggatggcgtggatcaacagacatcaccatccagggaggcgatgatgtgttcaaggagaactacgtgaccctcccaggaaccgtggatgaatgctacccaacctacctctaccagaagatcgacgagtcaaagctcaaggcttacacccgttatgaactccgtggctacatcgaagatagccaggatctcgaaatctatctcatccgttacaatgctaagcacgaaatcgtgaatgtgccaggaaccggctcactctggccactctcagcacagtcaccaatcggcaagtgcggcgaacccaatcgctgcgctcctcatctcgaatggaatcccgatctcgactgctcctgccgagacggcgagaagtgtgcacatcactcacaccacttcaccctcgacatcgacgtgggctgcaccgacctcaatgaagacctgggcgtgtgggtgatcttcaagatcaagacccaggacggccacgcacgactgggcaatctggagtttctggaggagaagccactgcttggcgaggcactggcacgagtgaaacgagccgagaagaaatggcgagacaaacgtgagaagctgcaactggagaccaacatcgtgtacaaagaggccaaagagtcagttgacgccctgtttgtcaatagccagtatgaccgactgcaagttgacaccaacatcgccatgatccacgctgcggacaagcgcgtccaccgcatccgcgaggcttatctgcccgagctgagcgtcattcccggcgtcaatgccgcgatcttcgaggagttagagggccgcatcttcaccgcctacagcctctatgacgcccgcaatgtcattaagaatggcgacttcaacaatggcttactatgctggaatgtcaaagggcacgttgacgtcgaggagcagaacaatcaccgcagcgtcttagtcatacccgagtgggaggccgaagtcagccaggaagtccgcgtctgtccagggcgcgggtacatcctgcgggtcaccgcctacaaagagggatacggcgagggttgtgtcaccatacacgagatagaggacaataccgacgaactcaagttcagcaattgtgtcgaggaggaagtctatcccaacaataccgtaacctgcaacaactacaccggaacccaggaggagtatgaagggacgtacacctcgcggaaccagggctatgacgaagcctatgggaacaacccgtcggtgcctgctgactatgcgtcggtctatgaggagaaatcgtacacggacgggcggcgggagaatccgtgtgagtcgaatcgcgggtatggtgactacacgccgctaccggcgggctatgtaacgaaagacctggaatacttcccggagacggacaaagtatggatagagataggcgagacggagggaacgttcatcgtggactcggtagagctgctgctcatggaggagtga

SEQ ID NO: 45 - protein, 1228 aa, Artificial
  Amino acid sequence of the chimeric protein variant TIC868_15.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATDATFEAESDLERAQKAVNALFTSSNQIGLKTDVTDYHIDQVSNLVDCLSDEFCLDEKRELSEKVKHAKRLSDERNLLQDPNFRGINRQPDRGWRGSTDITIQGGDDVFKENYVTLPGTVDECYPTYLYQKIDESKLKAYTRYELRGYIEDSQDLEIYLIRYNAKHEIVNVPGTGSLWPLSAQSPIGKCGEPNRCAPHLEWNPDLDCSCRDGEKCAHHSHHFTLDIDVGCTDLNEDLGVWVIFKIKTQDGHARLGNLEFLEEKPLLGEALARVKRAEKKWRDKREKLQLETNIVYKEAKESVDALFVNSQYDRLQVDTNIAMIHAADKRVHRIREAYLPELSVIPGVNAAIFEELEGRIFTAYSLYDARNVIKNGDFNNGLLCWNVKGHVDVEEQNNHRSVLVIPEWEAEVSQEVRVCPGRGYILRVTAYKEGYGEGCVTIHEIEDNTDELKFSNCVEEEVYPNNTVTCNNYTGTQEEYEGTYTSRNQGYDEAYGNNPSVPADYASVYEEKSYTDGRRENPCESNRGYGDYTPLPAGYVTKDLEYFPETDKVWIEIGETEGTFIVDSVELLLMEE

SEQ ID NO: 46 - DNA, 3600 bp, Artificial
  Synthetic nucleotide sequence designed for expression in a plant cell encoding TIC868_29.
atgacgagcaaccggaagaacgagaacgagatcatcaacgccctctcgatccctgctgtttcaaaccactccgcgcagatgaacctgtccaccgacgcgcgcatcgaggactccctctgcatagccgagggcaacaacatcgacccattcgtgtcggccagcacggttcagaccggcatcaacatcgcgggccgtatcctcggcgtcctcggtgtcccattcgccggtcagatcgcgtccttctactcgttccttgtgggcgagctgtggcctcgcggtcgtgacccgtgggagatcttcctggagcatgtggagcagttgatccggcagcaagtcacggagaacacccgcgatactgctctggccaggctacagggcctgggaaactcctttcgggcataccagtactcactggaggactggttggagaacagggatgacgcgcgaacacgctcggtactctacacccagtacatcgctctcgaactcgacttcctgaacgctatgccgctgttcgccatcaggaaccaggaagttccactccttatggtgtacgcccaggccgccaacttacatctgctcctgctgcgggacgccagcctgttcggctccgagttcggactcacatctcaagaaatccagcgttactacgagcgccaagtggagaagacccgtgagtacagtgactactgcgctcgatggtacaacacagggctcaacaacctgcgcggcaccaacgctgagtcatggctccgttacaaccagttccgccgcgacttgactttgggtgtcctagacctggtggcgctattcccgtcttacgacacacgggtgtacccaatgaacactagcgcgcaactcacgcgggagatctacacagacccaatcggccggacgaacgcaccctccggtttcgcatccacgaattggttcaacaacaacgcaccctccttctcggcaatcgaggccgccgtcatccgccctcctcacctgctcgactttcccgagcagctcacgatcttctcccagctctcacgctggtcccacacacagtacatgaactactgggtcgggcaccgattggagagtaggacgatccgtggcagcttgagcaccagtacccacggcaacaccaacacctccatcaacccagttacgctacagttcacgagccgcgacgtttaccggactgagtcgttcgcgggcattaacatccttctgacaacgcccgtcaacggcgtcccgtgggcccggttcaactggcgtaacccgttgaactccctgcgcgggtcattgctctacaccatcgggtacacgggcgtcggcacccagctcttcgacagtgaaactgagctgccgcccgagaccacggaacgcccgaactacgagtcctacagccaccgcctgtccaacatccggctcatctctggcaacacgctgcgtgcgccggtgtactcctggacacaccgcagcgccgaccggaccaacacgatctcttccgactccattaaccagatcccgctcgtgaagggcttccgtgtgtggggtggcacgagcgtcatcaccggtccgggcttcaccggtggagacatactgcggcgcaacactttcggcgacttcgtttcgttgcaagtgaacatcaactcgccgatcacccagcgttaccgtctgaggttccgctacgcttcaagccgcgacgcgagggtcattgtcctgaccggagccgcgtccacaggcgtgggaggccaagtctcagtcaacatgcctctccagaagacgatggagataggcgagaacttgactagccgaaccttccggtacactgatttctcgaaccctttctcattcagagcgaaccctgacatcattgggatctccgagcaaccgctgttcggtgctggctccatcagctctggcgaactgtacatcgacaagattgagatcatcctggcggatgcgacgttcgaggccgagtctgacctggagcgggctcagaaggctgtcaacgaactgttcaccagcagcaaccagattgggctcaagaccgacgtcacggactatcacattgaccaagtgtccaaccttgtggagtgcctgtccgacgagttctgcctcgacgagaagaaggagctgtccgagaaggtcaaacacgcgaagcgtctgagtgacgagcggaatttgctccaggacccgaacttccgtggcatcaaccgccagctcgaccgtggttggcgcgggagtacagacatcaccatccagggaggcgacgatgtgttcaaggagaactatgtgacgctgctcgggactttcgacgaatgctacccgacgtatctctaccagaagatagacgagagtaaattgaaggcgtacacccgctaccagcttcgcgggtacatcgaggatagtcaggacctggaaatctacctgatccgatacaacgccaagcacgagacagtgaacgtgccaggcacgggctcactttggccattgagcgctccctctccaatcggaaagtgcgctcaccactcgcaccacttctctctggacatcgacgtgggctgcaccgacctcaacgaggacctgggtgtctgggttatcttcaagattaagacccaggacggacatgcccgcctcggcaacctggagttccttgaggagaagcctctcgtgggcgaggccctcgctcgtgtgaagcgcgccgagaagaaatggcgagacaagcgggagaagctggagtgggagaccaacatcgtgtacaaggaggccaaggagtcagtggacgcactcttcgtcaacagccagtacgaccgcctccaggctgacaccaacatcgccatgatccacgcggctgacaagcgggtccacagcatccgtgaggcgtacctgcccgagctgtcagtgatccctggtgtgaacgcggcgatcttcgaggaactggagggccgcatcttcacagcattcagcctgtacgatgccaggaatgttattaagaacggtgacttcaacaacgggctgagttgctggaacgtcaagggccatgtggacgtcgaggagcagaacaaccaccggtccgtgctggtcgtgccggagtgggaggcagaggtgagccaggaggtccgcgtctgccctggtcgcggctacatcctccgtgtgactgcgtacaaggaaggctacggtgaaggctgcgtgactatccacgagatcgagaacaacaccgacgagctcaagttctcgaactgtgtggaggaggaggtgtacccgaacaacaccgttacttgcaacgactacactgccacgcaagaggagtacgagggcacttacacttcccggaatcgcggctatgatggcgcgtacgagtccaacagcagcgtgcctgcggattatgcgtccgcttacgaggagaaggcgtacaccgacggacggagggacaacccttgcgagtccaaccgtggctacggtgactacactccgctgcccgccgggtacgtcaccaaggagctggagtacttcccggagaccgacaaagtctggatcgagatcggcgagacggagggcactttcatcgtggactcggtcgagctgctactgatggaggagtga

SEQ ID NO: 47 - protein, 1199 aa, Artificial
  Amino acid sequence of the chimeric protein variant TIC868_29.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQYSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSQLSRWSHTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 48 - DNA, 3432 bp, Artificial
  Recombinant nucleotide sequence used for expression in a bacterial cell encoding TIC869.
atggagataaataatcagaagcaatgcataccatataattgcttaagtaatcctgaggaagtacttttggatggggagaggatattacctgatatcgatccactcgaagtttctttgtcgcttttgcaatttcttttgaataactttgttccagggggaggctttatttcaggattagttgataaaatatggggggctttgagaccatctgaatgggacttatttcttgcacagattgaacggttgattgatcaaagaatagaagcaacagtaagagcaaaagcaatcactgaattagaaggattagggagaaattatcaaatatacgctgaagcatttaaagaatgggaatcagatcctgataacgaagcggctaaaagtagagtaattgatcgctttcgtatacttgatggtctaattgaagcaaatatcccttcatttcggataattggatttgaagtgccacttttatcggtttatgttcaagcagctaatctacatctcgctctattgagagattctgttatttttggagagagatggggattgacgacaaaaaatgtcaatgatatctataatagacaaattagagaaattcatgaatatagcaatcattgcgtagatacgtataacacagaactagaacgtctagggtttagatctatagcgcagtggagaatatataatcagtttagaagagaactaacactaactgtattagatattgtcgctcttttcccgaactatgacagtagactgtatccgatccaaactttttctcaattgacaagagaaattgttacatccccagtaagcgaattttattatggtgttattaatagtggtaatataattggtactcttactgaacagcagataaggcgaccacatcttatggacttctttaactccatgatcatgtatacatcagataatagacgggaacattattggtcaggacttgaaatgacggcttattttacaggatttgcaggagctcaagtgtcattccctttagtcgggactagaggggagtcagctccaccattaactgttagaagtgttaatgatggaatttatagaatattatcggcaccgttttattcagcgccttttctaggcaccattgtattgggaagtcgtggagaaaaatttgattttgcgcttaataatatttcacctccgccatctacaatatacagacatcctggaacagtagattcactagtcagtataccgccacaggataatagcgtaccaccgcacaggggatctagtcatcgattaagtcatgttacaatgcgcgcaagttcccctatattccattggacgcatcgcagcgcaaccactacaaatacaattaatccaaatgctattatccaaataccactagtaaaagcatttaaccttcattcaggtgccactgttgttagaggaccagggtttacaggtggagatctcttacgaagaacgaatactggtacatttgcagacataagagtcaatgttccttcatcactattttcccaaagatatcgcgtaaggattcgttatgcttctactaccgatttacaatttttcacgagaattaatggaacttctgttaatcaaggtaatttctcaaaaacgatggatagaggggataaactgaaatctgaaaactttagaactgccggatttagtactccttttagattttcaaattttcaaagtacattcacgttgggtactcaggctttttcaaatcaggaagtttatatagatagaattgaatttgtcccggcagaagtaacattcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 49 - DNA, 3432 bp, Artificial
  Synthetic nucleotide sequence designed for expression in a plant cell encoding TIC869.
atggagataaacaaccagaagcagtgcattccgtacaactgcctcagcaacccggaggaggtgctgctggacggcgagcgtatcctcccagacatcgacccactggaggtcagcctgagcctcctccagttcctcctcaataacttcgtgccaggcggcggcttcatctccggcctggtggacaagatctggggcgcactccggccaagtgagtgggatctgttcctggcccaaatcgagcgcctgatcgaccagaggatcgaggcgacggtccgcgccaaggcgataaccgagctggagggcctcggtcgcaactaccagatctacgcagaggcgttcaaggagtgggagagcgacccggacaacgaggcggccaagtctcgggtgattgaccgcttccgcatcctcgacggcctcatcgaagccaacatcccttccttccggatcataggcttcgaagtcccgctcctcagcgtgtacgtgcaagcggccaatctccacctcgcgttgctccgtgacagcgtcatctttggcgagagatggggcctgacgacgaagaacgtgaacgacatctacaacaggcagatccgagagattcacgagtacagcaaccactgcgtggacacatacaacacggagctggagcggctcggcttccgctcaatcgctcagtggcggatctacaaccagttccgccgcgagctgaccctcaccgtgctcgacatcgtcgcattgtttcccaattacgactcacgcctctacccaatccagactttcagccagctcacacgcgagattgtgaccagcccggtgtcagagttctactacggcgtcatcaactcaggcaacatcatcgggacactgactgaacagcagatcagacgtccgcacttgatggacttcttcaactccatgattatgtacacatcagacaacaggagagagcactactggtccgggttggagatgactgcttacttcaccggcttcgccggtgcccaagtgagcttcccactggtcggaactcgtggcgagtcagctcctccgctaactgtgcgatctgtcaacgacgggatctacagaatactgtcggctcccttctacagtgcgccgttcctcggcaccatcgtcctcggctcacgtggtgagaagttcgacttcgcactgaacaacattagcccgccgcctagtacaatctacaggcaccctggcaccgtggactcactggtttcgatcccgccacaagacaacagtgtgccgccacatcgtggttctagccacaggctctcccatgtgaccatgcgcgcctcttcaccgatctttcactggacccatcggtccgctacaaccacaaacaccatcaaccctaacgccatcatccaaatcccgctggtgaaggcgtttaacctccacagcggcgcaactgtcgtgcgcggccctggattcaccggtggtgacctgctccgtcggaccaatactggcacgttcgcagacatccgagtgaacgtcccgtcctcgctgttcagtcagcgctaccgtgtccgcattcggtacgcttccaccacggatctccagttctttactcgcatcaatgggacgagcgtcaaccagggcaacttcagcaagacgatggaccgtggagataagctcaagtccgagaacttccgcacggctggcttctcgacaccgttcagattcagcaacttccagagcactttcacgctgggcacacaggcgttctccaaccaggaggtgtacatcgaccgcatcgagttcgtgcctgctgaggttaccttcgaggcggaaagcgacctcgaaagggcccagaaggccgtcaacgagctgttcacctccagcaaccagatcggtctcaagaccgacgtcactgactatcacattgaccaagtcagcaacctggtggagtgcctcagtgatgagttctgcctggatgagaagaaggagcttagcgagaaggtcaagcacgcaaagcgcttgagcgacgagcgcaaccttctccaggacccgaatttccgtggtatcaatagacagcttgaccgtgggtggcgcggtagtaccgacataaccatccagggtggcgacgatgtgttcaaggagaattatgttacgctgctcggtacgttcgacgagtgctatcccacgtacttgtaccagaagattgacgagagcaagctcaaggcgtacacccgttaccagctccgtggctacatcgaggacagccaggatctggaaatctaccttatccgatacaatgctaagcacgagacagtcaacgtgcccggaacagggtcgctctggccgctcagtgctccgtcgcccattggcaagtgcgcgcaccattcgcatcacttctcacttgacattgacgtgggctgcaccgacctgaacgaggatctgggtgtctgggtcatcttcaagatcaagacccaagacggccacgcgcgcctcgggaacctggagttcctggaggagaagcctttggtaggtgaagccctggcccgcgtcaagcgcgcggagaagaagtggcgcgacaagagggagaagctggaatgggagaccaacatcgtgtacaaggaggcgaaggagtcggtggacgcactattcgtgaactcccagtacgaccgtctccaggccgacaccaacatcgccatgatccacgccgctgacaaacgagttcattccattcgtgaagcctatcttcccgagctgtctgtcataccgggcgtcaacgcggccatcttcgaggagttagagggtcggatctttacagctttctcactgtacgatgcccgcaacgtcatcaagaacggcgacttcaacaacggtctctcctgttggaacgtgaagggccacgtggatgtcgaggagcagaacaaccaccgctctgtgcttgtggtgcccgagtgggaggccgaggtgagccaggaggtccgcgtctgtccgggtcgcggctacatcctgcgggtcaccgcctacaaggagggctacggcgaaggctgcgttactattcacgagattgagaacaataccgacgaactcaagttctccaactgtgtcgaggaggaggtgtacccgaacaacaccgtgacgtgcaacgactacaccgcgacacaggaggaatacgagggcacctacaccagccgcaaccgaggctacgacggagcgtacgagagcaactcgtccgtgcccgctgattacgcgagtgcgtacgaggagaaggcttacaccgacggacggcgcgacaatccctgcgagagtaaccgtggatacggagattacacgccgctacccgctggctacgtcactaaggaactggagtacttcccagagacggacaaggtgtggatcgaaatcggcgagacagagggcacgttcatcgtggactccgtggagctgctgctgatggaggagtga

SEQ ID NO: 50 - protein, 1143 aa, Artificial
  Amino acid sequence of the chimeric protein TIC869.
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRIIGFEVPLLSVYVQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKAFNLHSGATVVRGPGFTGGDLLRRTNTGTFADIRVNVPSSLFSQRYRVRIRYASTTDLQFFTRINGTSVNQGNFSKTMDRGDKLKSENFRTAGFSTPFRFSNFQSTFTLGTQAFSNQEVYIDRIEFVPAEVTFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 51 - DNA, 3513 bp, Artificial
  Recombinant nucleotide sequence used for expression in a bacterial cell encoding TIC836.
atggagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaaatttatattgaagcactaagagagtgggaagcaaatcctaataatgcacaattaagggaagatgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacacttactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaatacaattgatccggagaggattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 52 - DNA, 3513 bp, Artificial
  Synthetic nucleotide sequence designed for expression in a plant cell encoding TIC836.
atggagaacaacatccagaaccagtgcgtgccctacaactgcctgaacaaccctgaggttgagatcctgaacgaggagcgtagcaccggtaggctcccgctagacatctccctgagcctgacccgcttcctccttagtgagttcgtgcccggcgtgggcgtggccttcggcctcttcgacctcatctggggcttcatcactccttccgactggtccctcttcctccttcagattgagcaactgatcgagcagcgcatcgagacccttgagcgcaaccgcgccatcaccactctcagaggtctcgccgactcctacgaaatctacatcgaggcactccgtgagtgggaggccaacccgaacaatgcccagctccgcgaggacgtgaggatcagattcgccaacaccgacgatgccctcatcaccgccatcaacaatttcaccctcacctccttcgagatccctcttctgtctgtgtacgttcaagctgctaaccttcacctttccctcctgcgcgacgccgtgagcttcggccagggctggggcctcgacatcgccaccgtgaacaatcactacaaccgcctcatcaacctcatccaccgctacaccaagcactgccttgacacctacaaccagggccttgagaacctccgtggcaccaacacccgccagtgggcccgcttcaaccagttccgcagagacctcaccctcaccgtgctcgacatcgtggcactcttcccaaactacgacgtgcgtacctaccctatccagacctccagccagctcaccagggaaatctacacctccagcgtgatcgaggactctcctgtgtccgccaacatccctaacggcttcaaccgcgccgagttcggcgtgcgccctcctcacctcatggacttcatgaactccctcttcgtcactgccgagaccgtgcgctcccagaccgtgtggggcggtcacctcgtgtccagccgtaacaccgctggcaacaggatcaacttcccgtcctacggcgtgttcaacccaggcggtgccatctggatcgccgatgaagaccctcgtcctttctaccgtaccctgtccgaccctgtgttcgtgcgtggcggtttcggcaaccctcactacgtgctgggcctgcgtggcgtggccttccagcaaaccggcaccaaccacaccaggacgttccgtaactccggcaccatcgacagtcttgacgagatccctccgcaagacaactccggtgcaccttggaacgactactcccacgtgctgaaccacgtgaccttcgtgaggtggcctggcgaaatctccggctccgactcctggagggctcctatgttcagttggacccacaggagcgctacgcctaccaacaccatcgaccctgagcgtatcactcagatccctctgactaagagcactaacctgggcagcggcactagcgtggtcaagggccctggcttcactggcggtgacatcctgaggcggactagccctggccagatcagcactctgagggtgaacatcactgctccgctgagccagcgttacagggtcagaatccgttacgcttctactactaaccttcagttccacactagcatcgacggccgtccgatcaaccagggcaacttctctgctactatgagttctggcagtaacctccagtctggtagtttccggactgtcggtttcactacgccgttcaacttctccaacggtagttctgtcttcactctgtctgctcacgtgttcaactctggcaacgaggtgtacatcgaccggatcgagttcgtccctgctgaggtgacgttcgaggccgagtacgacctggagcgggctcagaaggctgtcaacgctctgttcacttctactaaccagcttggtttgaagactaacgtgaccgactaccacattgatcaagtcagtaacctggtcacgtacctgtctgacgagttctgtcttgacgagaagcgggagctgtctgagaaggtcaagcacgctaagcggctgtctgacgagcggaacctgcttcaagacagtaacttcaaggacattaaccgccagcctgagcgtggttggggagggtccacgggtattacgattcaaggaggtgacgatgtctttaaggagaactatgtgacgctttcgggtacgtttgatgagtgctatccaacgtacctttaccagaagattgacgagtcgaagctgaaggctttcactcgttaccagcttcgtggttacattgaggactcgcaagacctcgaaatctacctcattcgttacaacgctaagcacgagactgtcaacgtccctggtacgggtagtctttggccgctttctgctcagtcgccgattggcaagtgtggcgagccgaaccgttgcgctcctcacttggagtggaacccggatctcgattgctcgtgccgtgacggtgagaagtgcgcgcaccatagtcatcactttagccttgacattgatgtcggttgcacggatcttaacgaggatcttggagtctgggtgattttcaagatcaaaactcaggatgggcacgcgcgtcttgggaatcttgagttcctggaggagaagccacttgtcggtgaggcgcttgcgcgtgtcaagcgtgcggagaagaaatggcgtgataagcgtgagaagttggagtgggagacgaacatcgtgtacaaggaggcgaaggagtcggtcgatgcgttgtttgtcaatagtcaatacgatcaattgcaagcggatacgaacatcgcaatgattcatgcggcagataagcgtgtccattcgattcgtgaggcgtacttgccagagttgtcggtcatcccaggagttaatgcggcaatctttgaggaattggagggcagaatcttcacggcgttctcgttgtacgatgcaagaaatgttattaagaatggagatttcaacaatgggttgtcatgctggaatgttaagggtcacgttgatgttgaagaacagaacaaccagagatcagtgttggttgtaccagagtgggaggcagaggtttcacaagaggtgagagtttgcccaggcagaggctacatcttgagagttacagcatacaaagagggatacggcgagggatgtgttacaatccacgaaatcgagaacaataccgatgagctaaagttctcaaattgtgttgaggaggagatctacccgaacaacacggttacttgtaatgattacacagtgaaccaggaggagtatggtggtgcatacacatcaagaaatagaggctacaatgaagcaccatcagttccagcagattatgcctcagtttatgaggagaagtcatacacagatggacgacgtgagaatccatgtgagttcaatcgaggataccgagattacacaccactaccagttggatacgttacaaaggaactagaatacttcccagaaacagataaagtatggatagagatcggagaaacagaaggaacattcatcgttgattcagtagaactactacttatggaagaatga

SEQ ID NO: 53 - protein, 1170 aa, Artificial
  Amino acid sequence of the chimeric protein TIC836.
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLTKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 54 - DNA, 3588 bp, Artificial
  Chimeric coding sequence encoding TIC713
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatacgattggaccaaatagaattacacaaataccattggtaaaagcactgaatcttcattcaggtgttactgttgttggagggccaggatttacaggtggggatatccttcgtagaacaaatacgggtacatttggagatatacgattaaatattaatgtgccattatcccaaagatatcgcgtaaggattcgttatgcttctactacagatttacaatttttcacgagaattaatggaaccactgttaatattggtaatttctcaagaactatgaataggggggataatttagaatatagaagttttagaactgcaggatttagtactccttttaattttttaaatgcccaaagcacattcacattgggtgctcagagtttttcaaatcaggaagtttatatagatagagtcgaatttgttccagcagaggtaacatttgaggcagaatatgatttagaaagagcacaaaaggcggtgaatgctctgtttacttctacaaatccaagaagattgaaaacagatgtgacagattatcatattgaccaagtgtccaatatggtggcatgtttatcagatgaattttgcttggatgagaagcgagaattatttgagaaagtgaaatatgcgaagcgactcagtgatgaaagaaacttactccaagatccaaacttcacattcatcagtgggcaattaagtttcgcatccatcgatggacaatcaaacttcccctctattaatgagctatctgaacatggatggtggggaagtgcgaatgttaccattcaggaagggaatgacgtatttaaagagaattacgtcacactaccgggtacttttaatgagtgttatccaaattatttatatcaaaaaataggagagtcagaattaaaagcttatacgcgctatcaattaagagggtatattgaagatagtcaagatctagagatttatttaattcgttacaatgcaaagcatgaaacattggatgttccaggtaccgattccctatggccgctttcagttgaaagcccaatcggaaggtgcggagaaccaaatcgatgcgcaccacattttgaatggaatcctgatctagattgttcctgcagagatggagaaagatgtgcgcatcattcccatcatttcactttggatattgatgttgggtgcacagacttgcatgagaacctaggcgtgtgggtggtattcaagattaagacgcaggaaggttatgcaagattaggaaatctggaatttatcgaagagaaaccattaattggagaagcactgtctcgtgtgaagagagcggaaaaaaaatggagagacaaacgggaaaaactacaattggaaacaaaacgagtatatacagaggcaaaagaagctgtggatgctttattcgtagattctcaatatgatcaattacaagcggatacaaacattggcatgattcatgcggcagataaacttgttcatcgaattcgagaggcgtatctttcagaattacctgttatcccaggtgtaaatgcggaaatttttgaagaattagaaggtcacattatcactgcaatgtccttatacgatgcgagaaatgtcgttaaaaatggtgattttaataatggattaacatgttggaatgtaaaagggcatgtagatgtacaacagagccatcatcgttctgaccttgttatcccagaatgggaagcagaagtgtcacaagcagttcgcgtctgtccggggcgtggctatatccttcgtgtcacagcgtacaaagagggatatggagagggctgcgtaacgatccatgaaatcgagaacaatacagacgaactaaaatttaaaaactgtgaagaagaggaagtgtatccaacggatacaggaacgtgtaatgattatactgcacaccaaggtacagcagcatgtaattcccgtaatgctggatatgaggatgcatatgaagttgatactacagcatctgttaattacaaaccgacttatgaagaagaaacgtatacagatgtacgaagagataatcattgtgaatatgacagagggtatgtgaattatccaccagtaccagctggttatgtgacaaaagaattagaatacttcccagaaacagatacagtatggattgagattggagaaacggaaggaaagtttattgtagatagcgtggaactactcctcatggaagaatag

SEQ ID NO: 55 - protein, 1195 aa, Artificial
  Amino acid sequence of the chimeric protein TIC713.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNPRRLKTDVTDYHIDQVSNMVACLSDEFCLDEKRELFEKVKYAKRLSDERNLLQDPNFTFISGQLSFASIDGQSNFPSINELSEHGWWGSANVTIQEGNDVFKENYVTLPGTFNECYPNYLYQKIGESELKAYTRYQLRGYIEDSQDLEIYLIRYNAKHETLDVPGTDSLWPLSVESPIGRCGEPNRCAPHFEWNPDLDCSCRDGERCAHHSHHFTLDIDVGCTDLHENLGVWVVFKIKTQEGYARLGNLEFIEEKPLIGEALSRVKRAEKKWRDKREKLQLETKRVYTEAKEAVDALFVDSQYDQLQADTNIGMIHAADKLVHRIREAYLSELPVIPGVNAEIFEELEGHIITAMSLYDARNVVKNGDFNNGLTCWNVKGHVDVQQSHHRSDLVIPEWEAEVSQAVRVCPGRGYILRVTAYKEGYGEGCVTIHEIENNTDELKFKNCEEEEVYPTDTGTCNDYTAHQGTAACNSRNAGYEDAYEVDTTASVNYKPTYEEETYTDVRRDNHCEYDRGYVNYPPVPAGYVTKELEYFPETDTVWIEIGETEGKFIVDSVELLLMEE

SEQ ID NO: 56 - DNA, 3531 bp, Artificial
  Chimeric coding sequence encoding TIC843.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatacgattggaccaaatagaattacacaaataccattggtaaaagcactgaatcttcattcaggtgttactgttgttggagggccaggatttacaggtggggatatccttcgtagaacaaatacgggtacatttggagatatacgattaaatattaatgtgccattatcccaaagatatcgcgtaaggattcgttatgcttctactacagatttacaatttttcacgagaattaatggaaccactgttaatattggtaatttctcaagaactatgaataggggggataatttagaatatagaagttttagaactgcaggatttagtactccttttaattttttaaatgcccaaagcacattcacattgggtgctcagagtttttcaaatcaggaagtttatatagatagagtcgaatttgttccagcagaggtaacatttgaggcagaatatgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 57 - protein, 1176 aa, Artificial
  Amino acid sequence of the chimeric protein TIC843.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 58 - DNA, 3501 bp, Artificial
  Chimeric coding sequence encoding TIC862.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatattaaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaaatccctgcagtgaagggaaactttctttttaatggttctgtaatttcaggaccaggatttactggtggggacttagttagatgtacgaatggatctggattaactttatatgttacaccggcaccggacttgacgtattctaaaacatataaaattcgaattcgttatgcttctacatctcaggtgagatttggaattgacttaggcagttacactcatagtatttcgtatttcgataaaacgatggataaaggaaatacattaacgtataattcatttaatttatcaagtgtcagcagaccaattgaaatatcaggagggaataaaatcggggtatccgtcggaggtattggctctggggatgaagtttatatagacaaaatcgaatttattccaatggaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 59 - protein, 1166 aa, Artificial
  Amino acid sequence of the chimeric protein TIC862.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQIPAVKGNFLFNGSVISGPGFTGGDLVRCTNGSGLTLYVTPAPDLTYSKTYKIRIRYASTSQVRFGIDLGSYTHSISYFDKTMDKGNTLTYNSFNLSSVSRPIEISGGNKIGVSVGGIGSGDEVYIDKIEFIPMERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 60 - DNA, 3549 bp, Artificial
  Chimeric coding sequence encoding TIC1099.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 61 - protein, 1182 aa, Artificial
  Amino acid sequence of the chimeric protein TIC1099.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 62 - DNA, 3549 bp, Artificial
  Chimeric coding sequence encoding TIC1099 T507E.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcgaatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 63 - protein, 1182 aa, Artificial
  Amino acid sequence of the chimeric protein TIC1099 T507E.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGEFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 64 - DNA, 3549 bp, Artificial
  Chimeric coding sequence encoding TIC1099 R522K.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcacatttggaacgttaagagtaacagttaattcaccattaacacaaaaatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 65 - protein, 1182 aa, Artificial
  Amino acid sequence of the chimeric protein TIC1099 R522K.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGTFGTLRVTVNSPLTQKYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 66 - DNA, 3549 bp, Artificial
  Chimeric coding sequence encoding TIC1099 K490S.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttatcaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 67 - protein, 1182 aa, Artificial
  Amino acid sequence of the chimeric protein TIC1099 K490S.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLSGPGFTGGGILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 68 - DNA, 3549 bp, Artificial
  Chimeric coding sequence encoding TIC1099 T562R.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactacgctacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 69 - protein, 1182 aa, Artificial
  Amino acid sequence of the chimeric protein TIC1099 T526R.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGTFGTLRVTVNSPLTQRYRVRVRFASSGNFSIRILRGNTSIAYQRFGSTMNRGQELRYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 70 - DNA, 3549 bp, Artificial
  Chimeric coding sequence encoding TIC1099 S553R.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggcgtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 71 - protein, 1182 aa, Artificial
  Amino acid sequence of the chimeric protein TIC1099 S553R.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGTFGTLRVTVNSPLTQRYRVRVRFASSGNFSIRILRGNTSIAYQRFGRTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 72 - DNA, 3549 bp, Artificial
  Chimeric coding sequence encoding TIC1099 G498D.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggaggggatatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 73 - protein, 1182 aa, Artificial
  Amino acid sequence of the chimeric protein TIC1099 G498D.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGDILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 74 - DNA, 3549 bp, Artificial
  Chimeric coding sequence encoding TIC1099 K490A.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttagcaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgaatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 75 - protein, 1182 aa, Artificial
  Amino acid sequence of the chimeric protein TIC1099 K490A.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLAGPGFTGGGILRRTTNGTFGTLRVTVNSPLTQRYRVRVRFASSGNFSIRILRGNTSIAYQRFGSTMNRGQELTYESFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 76 - DNA, 3549 bp, Artificial
  Chimeric coding sequence encoding TIC1099 E564A.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattacacaattaccattggtaaaggcatctgcacctgtttcgggtactacggtcttaaaaggtccaggatttacaggagggggtatactccgaagaacaactaatggcacatttggaacgttaagagtaacagttaattcaccattaacacaaagatatcgcgtaagagttcgttttgcttcatcaggaaatttcagcataaggatactgcgtggaaatacctctatagcttatcaaagatttgggagtacaatgaacagaggacaggaactaacttacgcatcatttgtcacaagtgagttcactactaatcagagcgatctgccttttacatttacacaagctcaagaaaatttaacaatccttgcagaaggtgttagcaccggtagtgaatattttatagatagaattgaaatcatccctgtgaacccggcacgagaagcagaagaggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 77 - protein, 1182 aa, Artificial
  Amino acid sequence of the chimeric protein TIC1099 E564A.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPLVKASAPVSGTTVLKGPGFTGGGILRRTTNGTFGTLRVTVNSPLTQRYRVRVRFASSGNFSIRILRGNTSIAYQRFGSTMNRGQELTYASFVTSEFTTNQSDLPFTFTQAQENLTILAEGVSTGSEYFIDRIEIIPVNPAREAEEDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 78 - DNA, 3534 bp, Artificial
  Chimeric coding sequence encoding TIC1103.
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgttcccggtgctggatttgtgttaggactagttgatataatatggggaatttttggtccctctcaatgggacgcatttcttgtacaaattgaacagttaattaaccaaagaatagaagaattcgctaggaaccaagccatttctagattagaaggactaagcaatctttatcaaatttacgcagaatcttttagagagtgggaagcagatcctactaatccagcattaagagaagagatgcgtattcaattcaatgacatgaacagtgcccttacaaccgctattcctcttttggcagttcaaaattatcaagttcctcttttatcagtatatgttcaagctgcaaatttacatttatcagttttgagagatgtttcagtgtttggacaaaggtggggatttgatgccgcgactatcaatagtcgttataatgatttaactaggcttattggcaactatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaactacccatggtaaaggcaaatgctttactttcaggtacttccgtgataaagggtcctggatctacagggggagatatattaagaagaacaagtgttggcagagtaggaaattttaaggttaacgtaaatggaccattaacacaacgatatcttgtaagaattcgttatgcttctacaactgatctagacttttacgtctatcgtggaggtaccactgtaagtaattatagatttaacaaaacaatgaataagggagcttctttaacttacgacatttttaaatttgcaagtttttctacccctttcacatttacaaaaacacaagatgaattaggaatatctatacaaaactttagtagcggtgaagaagtgtatatagacaggattgaagtcattccagtaggtacgacatatgaagcggaaacggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 79 - protein, 1177 aa, Artificial
  Amino acid sequence of the chimeric protein TIC1103.
MDNNPNINECIPYNCLSNPEVEVLGGERIETGYTPIDISLSLTQFLLSEFVPGAGFVLGLVDIIWGIFGPSQWDAFLVQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDAATINSRYNDLTRLIGNYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPMVKANALLSGTSVIKGPGSTGGDILRRTSVGRVGNFKVNVNGPLTQRYLVRIRYASTTDLDFYVYRGGTTVSNYRFNKTMNKGASLTYDIFKFASFSTPFTFTKTQDELGISIQNFSSGEEVYIDRIEVIPVGTTYEAETDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 80 - DNA, 3597 bp, Artificial
  Chimeric coding sequence encoding TIC1101.
atgaaaaacagtatcaaattatcagaactttggtatttcaatgaaagaaaatggaggtattttatggagatagtgaataatcagaatcaatgcgtgccttataattgtttgaataatcccgaaatcgaaatattagaaggcggaagaatatcagttggtaataccccaattgatatttctctttcgcttactcagtttcttttgagtgaatttgtcccaggtgcggggtttgtattaggattaattgatttaatatggggatttgtaggtccttcccaatgggacgcatttcttgctcaagtggaacagttaattaaccaaagaatagcagaagctgtaagaaatacagcaattcaggaattagagggaatggcacgggtttatagaacctatgctactgcttttgctgagtgggaaaaagctcctgatgacccagagctaagagaagcactacgtacacaatttacagcaactgagacttatataagtggaagaatatccgttttaaaaattcaaacttttgaagtacagctgttatcagtgtttgcccaagctgcaaatttacatttatctttattaagagacgttgtgttttttgggcaaagatggggtttttcaacgacaaccgtaaataattactacaatgatttaacagaagggattagtacctatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccgccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattgcatcggatagtattactcaactacccatggtaaaggcaaatgctttactttcaggtacttccgtgataaagggtcctggatctacagggggagatatattaagaagaacaagtgttggcagagtaggaaattttaaggttaacgtaaatggaccattaacacaacgatatcttgtaagaattcgttatgcttctacaactgatctagacttttacgtctatcgtggaggtaccactgtaagtaattatagatttaacaaaacaatgaataagggagcttctttaacttacgacatttttaaatttgcaagtttttctacccctttcacatttacaaaaacacaagatgaattaggaatatctatacaaaactttagtagcggtgaagaagtgtatatagacaggattgaagtcattccagtaggtacgacatatgaagcggaaacggatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 81 - protein, 1198 aa, Artificial
  Amino acid sequence of the chimeric protein TIC1101.
MKNSIKLSELWYFNERKWRYFMEIVNNQNQCVPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIASDSITQLPMVKANALLSGTSVIKGPGSTGGDILRRTSVGRVGNFKVNVNGPLTQRYLVRIRYASTTDLDFYVYRGGTTVSNYRFNKTMNKGASLTYDIFKFASFSTPFTFTKTQDELGISIQNFSSGEEVYIDRIEVIPVGTTYEAETDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 82 - DNA, 3573 bp, Artificial
  Chimeric coding sequence encoding TIC845.
atgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgagacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaacataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattccagttactgcaacactcgaggctgaatataatctggaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 83 - protein, 1190 aa, Artificial
  Amino acid sequence of the chimeric protein TIC845.
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 84 - DNA, 3567 bp, Artificial
  Chimeric coding sequence encoding TIC846.
atgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgagacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaatacgattggaccaaatagaattacacaaataccattggtaaaagcactgaatcttcattcaggtgttactgttgttggagggccaggatttacaggtggagatatccttcgaagaacgaatactggcacatttgcagatatgagagtaaatattactgggccattatcccaaagatatcgtgtaagaattcgctatgcttctacgacagatttacaatttttcacgagaatcaatggaacttctgtaaatcaaggtaatttccaaagaactatgaatagaggggataatttagaatctggaaactttaggactgcaggatttagtacgccttttagtttttcaaatgcgcaaagtacattcacattgggtactcaggctttttcaaatcaggaagtttatatagatcgaattgaatttgtcccggcagaagtaacattcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 85 - protein, 1188 aa, Artificial
  Amino acid sequence of the chimeric protein TIC846.
  MISC_FEATURE (1)..(1188): Amino acid sequence of the chimeric protein TIC846.
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKALNLHSGVTVVGGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 86 - DNA, 3570 bp, Artificial
  Chimeric coding sequence encoding TIC858.
atgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgagacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaatacgattggaccaaatagaattacccaaatcccaatggtaaaagcatccgaacttcctcaaggtaccactgttgttagaggaccaggatttactggtggggatattcttcgaagaacgaatactggtggatttggaccgataagagtaactgttaacggaccattaacacaaagatatcgtataggattccgctatgcttcaactgtagattttgatttctttgtatcacgtggaggtactactgtaaataattttagattcctacgtacaatgaacagtggagacgaactaaaatacggaaattttgtgagacgtgcttttactacaccttttacttttacacaaattcaagatataattcgaacgtctattcaaggccttagtggaaatggggaagtgtatatagataaaattgaaattattccagttactgcaaccttcgaagcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 87 - protein, 1189 aa, Artificial
  Amino acid sequence of the chimeric protein TIC858.
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 88 - DNA, 3570 bp, Artificial
  Chimeric coding sequence encoding TIC865.
atgacttcaaataggaaaaatgagaatgaaattataaatgccttatcgattccagctgtatcgaatcattccgcacaaatggatctatcgctagatgctcgtattgaggattctttgtgtatagccgaggggaataatatcaatccacttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaacacaattgatccggagaggattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacatttgaagcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 89 - protein, 1189 aa, Artificial
  Amino acid sequence of the chimeric protein TIC865.
MTSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 90 - DNA, 3564 bp, Artificial
  Chimeric coding sequence encoding TIC866.
atgacttcaaataggaaaaatgagaatgaaattataaatgctttatcgattccagctgtatcgaatcattccgcacaaatgaatctatcaaccgatgctcgtattgaggatagcttgtgtatagccgaggggaacaatatcgatccatttgttagcgcatcaacagtccaaacgggtattaacatagctggtagaatactaggtgtattaggcgtaccgtttgctggacaaatagctagtttttatagttttcttgttggtgaattatggccccgcggcagagatccttgggaaattttcctagaacatgtcgaacaacttataagacaacaagtaacagaaaatactagggatacggctcttgctcgattacaaggtttaggaaattcctttagagcctatcaacagtcacttgaagattggctagaaaaccgtgatgatgcaagaacgagaagtgttctttatacccaatatatagccttagaacttgattttcttaatgcgatgccgcttttcgcaattagaaaccaagaagttccattattaatggtatatgctcaagctgcaaatttacacctattattattgagagatgcctctctttttggtagtgaatttgggcttacatcccaagaaattcaacgttattatgagcgccaagtggaaaaaacgagagaatattctgattattgcgcaagatggtataatacgggtttaaataatttgagagggacaaatgctgaaagttggttgcgatataatcaattccgtagagacttaacgctaggagtattagatctagtggcactattcccaagctatgacacgcgtgtttatccaatgaataccagtgctcaattaacaagagaaatttatacagatccaattgggagaacaaatgcaccttcaggatttgcaagtacgaattggtttaataataatgcaccatcgttttctgccatagaggctgccgttattaggcctccgcatctacttgattttccagaacagcttacaattttcagcgtattaagtcgatggagtaatactcaatatatgaattactgggtgggacatagacttgaatcgcgaacaataagggggtcattaagtacctcgacacacggaaataccaatacttctattaatcctgtaacattacagttcacatctcgagacgtttatagaacagaatcatttgcagggataaatatacttctaactactcctgtgaatggagtaccttgggctagatttaattggagaaatcccctgaattctcttagaggtagccttctctatactatagggtatactggagtggggacacaactatttgattcagaaactgaattaccaccagaaacaacagaacgaccaaattatgaatcttacagtcatagattatctaatataagactaatatcaggaaacactttgagagcaccagtatattcttggacgcaccgtagtgcagatcgtacaaataccattagttcagatagcattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacatttgaagcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 91 - protein, 1187 aa, Artificial
  Amino acid sequence of the chimeric protein TIC866.
MTSNRKNENEIINALSIPAVSNHSAQMNLSTDARIEDSLCIAEGNNIDPFVSASTVQTGINIAGRILGVLGVPFAGQIASFYSFLVGELWPRGRDPWEIFLEHVEQLIRQQVTENTRDTALARLQGLGNSFRAYQQSLEDWLENRDDARTRSVLYTQYIALELDFLNAMPLFAIRNQEVPLLMVYAQAANLHLLLLRDASLFGSEFGLTSQEIQRYYERQVEKTREYSDYCARWYNTGLNNLRGTNAESWLRYNQFRRDLTLGVLDLVALFPSYDTRVYPMNTSAQLTREIYTDPIGRTNAPSGFASTNWFNNNAPSFSAIEAAVIRPPHLLDFPEQLTIFSVLSRWSNTQYMNYWVGHRLESRTIRGSLSTSTHGNTNTSINPVTLQFTSRDVYRTESFAGINILLTTPVNGVPWARFNWRNPLNSLRGSLLYTIGYTGVGTQLFDSETELPPETTERPNYESYSHRLSNIRLISGNTLRAPVYSWTHRSADRTNTISSDSITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 92 - DNA, 3525 bp, Artificial
  Chimeric coding sequence encoding TIC838.
atggaggaaaataatcaaaatcaatgcataccttacaattgtttaagtaatcctgaagaagtacttttggatggagaacggatatcaactggtaattcatcaattgatatttctctgtcacttgttcagtttctggtatctaactttgtaccagggggaggatttttagttggattaatagattttgtatggggaatagttggcccttctcaatgggatgcatttctagtacaaattgaacaattaattaatgaaagaatagctgaatttgctaggaatgctgctattgctaatttagaaggattaggaaacaatttcaatatatatgtggaagcatttaaagaatgggaagaagatcctaataatccagcaaccaggaccagagtaattgatcgctttcgtatacttgatgggctacttgaaagggacattccttcgtttgcaatttctggatttgaagtaccccttttatccgtttatgctcaagcggccaatctgcatctagctatattaagagattctgtaatttttggagaaagatggggattgacaacgataaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcagtcagttggtcaactaacaagggaaatttatacggacccattaattacttttaatccacagttacagtctgtagctcaattacctacttttaacgttatggaaagcaacgcaattagaactcctcatttatttgatgtattgaataatcttacaatttttacagattggtttagtgttggacgcaacttttattggggaggacatcgagtaatatctaaccgtataggaggaggtaacataacatctcctatatatggaagggaggcgaatcaggagcctccaagatcttttacttttaatgggcctgtttttaggactttatcaaatcctacttttagacctttacagcaaccttggccagcgccaccatttaatttacgtggtgttgaaggagtagaattttctacacctttaaatagctttacgtatcgaggaaggggtacggttgattctttaactgagttaccgcctgaggataatagtgtgcctcctcgcgaaggatatagtcatcgtttatgtcatgcaacttttgttcaaagatctggaaccccatttttaacaactggtccagtattttcttggacgcatcgtagtgctactgatcgaaatataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattcctgttactgcaacactcgaggctgaatataatctagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 93 - protein, 1174 aa, Artificial
  Amino acid sequence of the chimeric protein TIC838.
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFAISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQSVGQLTREIYTDPLITFNPQLQSVAQLPTFNVMESNAIRTPHLFDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLTELPPEDNSVPPREGYSHRLCHATFVQRSGTPFLTTGPVFSWTHRSATDRNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 94 - DNA, 3558 bp, Artificial
  Chimeric coding sequence encoding TIC839.
atggaggaaaataatcaaaatcaatgcataccttacaattgtttaagtaatcctgaagaagtacttttggatggagaacggatatcaactggtaattcatcaattgatatttctctgtcacttgttcagtttctggtatctaactttgtaccagggggaggatttttagttggattaatagattttgtatggggaatagttggcccttctcaatgggatgcatttctagtacaaattgaacaattaattaatgaaagaatagctgaatttgctaggaatgctgctattgctaatttagaaggattaggaaacaatttcaatatatatgtggaagcatttaaagaatgggaagaagatcctaataatccagcaaccaggaccagagtaattgatcgctttcgtatacttgatgggctacttgaaagggacattccttcgtttgcaatttctggatttgaagtaccccttttatccgtttatgctcaagcggccaatctgcatctagctatattaagagattctgtaatttttggagaaagatggggattgacaacgataaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcagtcagttggtcaactaacaagggaaatttatacggacccattaattacttttaatccacagttacagtctgtagctcaattacctacttttaacgttatggaaagcaacgcaattagaactcctcatttatttgatgtattgaataatcttacaatttttacagattggtttagtgttggacgcaacttttattggggaggacatcgagtaatatctaaccgtataggaggaggtaacataacatctcctatatatggaagggaggcgaatcaggagcctccaagatcttttacttttaatgggcctgtttttaggactttatcaaatcctacttttagacctttacagcaaccttggccagcgccaccatttaatttacgtggtgttgaaggagtagaattttctacacctttaaatagctttacgtatcgaggaaggggtacggttgattctttaactgagttaccgcctgaggataatagtgtgcctcctcgcgaaggatatagtcatcgtttatgtcatgcaacttttgttcaaagatctggaaccccatttttaacaactggtccagtattttcttggacgcatcgtagtgctactgatcgaaatacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctctccagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattcctgttactgcaacactcgaggctgaatataatctagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaatag

SEQ ID NO: 95 - protein, 1185 aa, ARtificial
  Amino acid sequence of the chimeric protein TIC839.
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFAISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQSVGQLTREIYTDPLITFNPQLQSVAQLPTFNVMESNAIRTPHLFDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLTELPPEDNSVPPREGYSHRLCHATFVQRSGTPFLTTGPVFSWTHRSATDRNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIIPVTATLEAEYNLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 96 - DNA, 3519 bp, Artificial
  Chimeric coding sequence encoding TIC841.
atggaggaaaataatcaaaatcaatgcataccttacaattgtttaagtaatcctgaagaagtacttttggatggagaacggatatcaactggtaattcatcaattgatatttctctgtcacttgttcagtttctggtatctaactttgtaccagggggaggatttttagttggattaatagattttgtatggggaatagttggcccttctcaatgggatgcatttctagtacaaattgaacaattaattaatgaaagaatagctgaatttgctaggaatgctgctattgctaatttagaaggattaggaaacaatttcaatatatatgtggaagcatttaaagaatgggaagaagatcctaataatccagcaaccaggaccagagtaattgatcgctttcgtatacttgatgggctacttgaaagggacattccttcgtttgcaatttctggatttgaagtaccccttttatccgtttatgctcaagcggccaatctgcatctagctatattaagagattctgtaatttttggagaaagatggggattgacaacgataaatgtcaatgaaaactataatagactaattaggcatattgatgaatatgctgatcactgtgcaaatacgtataatcggggattaaataatttaccgaaatctacgtatcaagattggataacatataatcgattacggagagacttaacattgactgtattagatatcgccgctttctttccaaactatgacaataggagatatccaattcagtcagttggtcaactaacaagggaaatttatacggacccattaattacttttaatccacagttacagtctgtagctcaattacctacttttaacgttatggaaagcaacgcaattagaactcctcatttatttgatgtattaaataatcttacaatttttacagattggtttagtgttggacgcaacttttattggggaggacatcgagtaatatctaaccgtataggaggaggtaacataacatctcctatatatggaagggaggcgaatcaggagcctccaagatcttttacttttaatgggcctgtttttaggactttatcaaatcctacttttagacctttacagcaaccttggccagcgccaccatttaatttacgtggtgttgaaggagtagaattttctacacctttaaatagctttacgtatcgaggaaggggtacggttgattctttaactgagttaccgcctgaggataatagtgtgcctcctcgcgaaggatatagtcatcgtttatgtcatgcaacttttgttcaaagatctggaaccccatttttaacaactggtccagtattttcttggacgcatcgtagtgctactgatcgaaatacaattgatccagagagaattaatcaaatacctttagtgaaaggatttagagtttgggggggcacctctgtcattacaggaccaggatttacaggaggggatatccttagaagaacgaatactggcacatttgcagatatgagagtaaatattactgggccattatcccaaagatatcgtgtaagaattcgctatgcttctacgacagatttacaatttttcacgagaatcaatggaacttctgtaaatcaaggtaatttccaaagaactatgaatagaggggataatttagaatctggaaactttaggactgcaggatttagtacgccttttagtttttcaaatgcgcaaagtacattcacattgggtactcaggctttttcaaatcaggaagtttatatagatcgaattgaatttgtcccggcagaagtaacattcgaggcagaatctgatttagaaagagcgcagaaggcggtgaatgcgctgtttacgtctacaaaccaactagggctaaaaacaaatgtaacggattatcatattgatcaagtgtccaatttagttacgtatttatcggatgaattttgtctggatgaaaagcgagaattgtccgagaaagtcaaacatgcgaagcgactcagtgatgaacgcaatttactccaagattcaaatttcaaagacattaataggcaaccagaacgtgggtggggcggaagtacagggattaccatccaaggaggggatgacgtatttaaagaaaattacgtcacactatcaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagaaaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaggaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgtagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 97 - protein, 1172 aa, Artificial
  Amino acid sequence of the chimeric protein TIC841.
MEENNQNQCIPYNCLSNPEEVLLDGERISTGNSSIDISLSLVQFLVSNFVPGGGFLVGLIDFVWGIVGPSQWDAFLVQIEQLINERIAEFARNAAIANLEGLGNNFNIYVEAFKEWEEDPNNPATRTRVIDRFRILDGLLERDIPSFAISGFEVPLLSVYAQAANLHLAILRDSVIFGERWGLTTINVNENYNRLIRHIDEYADHCANTYNRGLNNLPKSTYQDWITYNRLRRDLTLTVLDIAAFFPNYDNRRYPIQSVGQLTREIYTDPLITFNPQLQSVAQLPTFNVMESNAIRTPHLFDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLTELPPEDNSVPPREGYSHRLCHATFVQRSGTPFLTTGPVFSWTHRSATDRNTIDPERINQIPLVKGFRVWGGTSVITGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNALFTSTNQLGLKTNVTDYHIDQVSNLVTYLSDEFCLDEKRELSEKVKHAKRLSDERNLLQDSNFKDINRQPERGWGGSTGITIQGGDDVFKENYVTLSGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 98 - DNA, 3516 bp, Artificial
  Chimeric coding sequence encoding TIC842.
atggcagagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaaatttatattgaagcactaagagagtgggaagcaaatcctaataatgcacaattaagggaagatgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacgctaactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaatacaattgatccggagaggattactcaaataccattggtaaaagcacatacacttcagtcaggtactactgttgtaagagggcccgggtttacgggaggagatattcttcgacgaacaagtggaggaccatttgcttatactattgttaatataaatgggcaattaccccaaaggtatcgtgcaagaatacgctatgcctctactacaaatctaagaatttacgtaacggttgcaggtgaacggatttttgctggtcaatttaacaaaacaatggataccggtgacccattaacattccaatcttttagttacgcaactattaatacagcttttacattcccaatgagccagagtagtttcacagtaggtgctgatacttttagttcagggaatgaagtttatatagacagatttgaattgattccagttactgcaacatttgaagcagaatatgatttagaaagagcacaaaaggcggtgaatgcgctgtttacttctataaaccaaatagggataaaaacagatgtgacggattatcatattgatcaagtatccaatttagtggattgtttatcagatgaattttgtctggatgaaaagcgagaattgtccgagaaagtcaaacatgcgaagcgactcagtgatgagcggaatttacttcaagatccaaacttcaaaggcatcaataggcaactagaccgtggttggagaggaagtacggatattaccatccaaagaggagatgacgtattcaaagaaaattatgtcacactaccaggtacctttgatgagtgctatccaacatatttgtatcaaaaaatcgatgaatcaaaattaaaagcctttacccgttatcaattaagagggtatatcgaagatagtcaagacttagaaatctatttaattcgctacaatgcaaaacatgaaacagtaaatgtgccaggtacgggttccttatggccgctttcagcccaaagtccaatcggaaagtgtggagagccgaatcgatgcgcgccacaccttgaatggaatcctgacttagattgttcgtgtagggatggagaaaagtgtgcccatcattcgcatcatttctccttagacattgatgtaggatgtacagacttaaatgaggacctaggtgtatgggtgatctttaagattaagacgcaagatgggcacgcaagactagggaatctagagtttctcgaagagaaaccattagtaggagaagcgctagctcgtgtgaaaagagcggagaaaaaatggagagacaaacgtgaaaaattggaatgggaaacaaatatcgtttataaagaggcaaaagaatctgtagatgctttatttgtaaactctcaatatgatcaattacaagcggatacgaatattgccatgattcatgcggcagataaacgtgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaacgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgcgtagaagaggaaatctatccaaataacacggtaacgtgtaatgattatactgtaaatcaagaagaatacggaggtgcgtacacttctcgtaatcgaggatataacgaagctccttccgtaccagctgattatgcgtcagtctatgaagaaaaatcgtatacagatggacgaagagagaatccttgtgaatttaacagagggtatagggattacacgccactaccagttggttatgtgacaaaagaattagaatacttcccagaaaccgataaggtatggattgagattggagaaacggaaggaacatttatcgtggacagcgtggaattactccttatggaggaataa

SEQ ID NO: 99 - protein, 1171 aa, Artificial
  Amino acid sequence of the chimeric protein TIC842.
MAENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQKAVNALFTSINQIGIKTDVTDYHIDQVSNLVDCLSDEFCLDEKRELSEKVKHAKRLSDERNLLQDPNFKGINRQLDRGWRGSTDITIQRGDDVFKENYVTLPGTFDECYPTYLYQKIDESKLKAFTRYQLRGYIEDSQDLEIYLIRYNAKHETVNVPGTGSLWPLSAQSPIGKCGEPNRCAPHLEWNPDLDCSCRDGEKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDQLQADTNIAMIHAADKRVHSIREAYLPELSVIPGVNAAIFEELEGRIFTAFSLYDARNVIKNGDFNNGLSCWNVKGHVDVEEQNNQRSVLVVPEWEAEVSQEVRVCPGRGYILRVTAYKEGYGEGCVTIHEIENNTDELKFSNCVEEEIYPNNTVTCNDYTVNQEEYGGAYTSRNRGYNEAPSVPADYASVYEEKSYTDGRRENPCEFNRGYRDYTPLPVGYVTKELEYFPETDKVWIEIGETEGTFIVDSVELLLMEE

SEQ ID NO: 100 - DNA, 3444 bp, Artificial
  Chimeric coding sequence encoding TIC850.
atggagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaaatttatattgaagcactaagagagtgggaagcaaatcctaataatgcacaattaagggaagatgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacgctaactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaatacaattgatccggagaggattactcaaataccattggtaaaagcacatacacttcagtcaggtactactgttgtaagagggcccgggtttacgggaggagatatccttcgaagaacgaatactggcacatttgcagatatgagagtaaatattactgggccattatcccaaagatatcgtgtaagaattcgctatgcttctacgacagatttacaatttttcacgagaatcaatggaacttctgtaaatcaaggtaatttccaaagaactatgaatagaggggataatttagaatctggaaactttaggactgcaggatttagtacgccttttagtttttcaaatgcgcaaagtacattcacattgggtactcaggctttttcaaatcaggaagtttatatagatcgaattgaatttgtcccggcagaagtaacattcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 101 - protein, 1147 aa, Artificial
  Amino acid sequence of the chimeric protein TIC850.
  MISC_FEATURE (1)..(1147): Amino acid sequence of the chimeric protein TIC850.
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNTIDPERITQIPLVKAHTLQSGTTVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 102 - DNA, 3447 bp, Artificial
  Chimeric coding sequence encoding TIC859.
atggagaataatattcaaaatcaatgcgtaccttacaattgtttaaataatcctgaagtagaaatattaaatgaagaaagaagtactggcagattaccgttagatatatccttatcgcttacacgtttccttttgagtgaatttgttccaggtgtgggagttgcgtttggattatttgatttaatatggggttttataactccttctgattggagcttatttcttttacagattgaacaattgattgagcaaagaatagaaacattggaaaggaaccgggcaattactacattacgagggttagcagatagctatgaaatttatattgaagcactaagagagtgggaagcaaatcctaataatgcacaattaagggaagatgtgcgtattcgatttgctaatacagacgacgctttaataacagcaataaataattttacacttacaagttttgaaatccctcttttatcggtctatgttcaagcggcgaatttacatttatcactattaagagacgctgtatcgtttgggcagggttggggactggatatagctactgttaataatcattataatagattaataaatcttattcatagatatacgaaacattgtttggacacatacaatcaaggattagaaaacttaagaggtactaatactcgacaatgggcaagattcaatcagtttaggagagatttaacgctaactgtattagatatcgttgctctttttccgaactacgatgttagaacatatccaattcaaacgtcatcccaattaacaagggaaatttatacaagttcagtaattgaggattctccagtttctgctaatatacctaatggttttaatagggcggaatttggagttagaccgccccatcttatggactttatgaattctttgtttgtaactgcagagactgttagaagtcaaactgtgtggggaggacacttagttagttcacgaaatacggctggtaaccgtataaatttccctagttacggggtcttcaatcctggtggcgccatttggattgcagatgaggatccacgtcctttttatcggacattatcagatcctgtttttgtccgaggaggatttgggaatcctcattatgtactggggcttaggggagtagcatttcaacaaactggtacgaaccacacccgaacatttagaaatagtgggaccatagattctctagatgaaatcccacctcaggataatagtggggcaccttggaatgattatagtcatgtattaaatcatgttacatttgtacgatggccaggtgagatttcaggaagtgattcatggagagctccaatgttttcttggacgcaccgtagtgcaacccctacaaacgaagttcgtgtatctagaattacacaattaccgatggtgaaggcgcatacgcttcatgcgggagctactgttgttagaggaccaggatttacaggaggagatatactccgaagaactacttcaggctcatttggggatatgagaataacaaatttttcaagttcatcatcgaggtatcgtgtaagaatacgttatgcttctactacagatttacaatttttcttgagtgttggaggaacccctgtcaatgtagccgatttcccgaaaaccatagatagaggggaaaacttagaatatggaagctttagaacggcaggttttactaccccttttagttttgtaagttcaacaaataatttcacattaggtgttcagagtgtttcttcaggtaacgagatttttgtagatcgaattgaatttgttccggcagatgcaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 103 - protein, 1148 aa, Artificial
  Amino acid sequence of the chimeric protein TIC859.
MENNIQNQCVPYNCLNNPEVEILNEERSTGRLPLDISLSLTRFLLSEFVPGVGVAFGLFDLIWGFITPSDWSLFLLQIEQLIEQRIETLERNRAITTLRGLADSYEIYIEALREWEANPNNAQLREDVRIRFANTDDALITAINNFTLTSFEIPLLSVYVQAANLHLSLLRDAVSFGQGWGLDIATVNNHYNRLINLIHRYTKHCLDTYNQGLENLRGTNTRQWARFNQFRRDLTLTVLDIVALFPNYDVRTYPIQTSSQLTREIYTSSVIEDSPVSANIPNGFNRAEFGVRPPHLMDFMNSLFVTAETVRSQTVWGGHLVSSRNTAGNRINFPSYGVFNPGGAIWIADEDPRPFYRTLSDPVFVRGGFGNPHYVLGLRGVAFQQTGTNHTRTFRNSGTIDSLDEIPPQDNSGAPWNDYSHVLNHVTFVRWPGEISGSDSWRAPMFSWTHRSATPTNEVRVSRITQLPMVKAHTLHAGATVVRGPGFTGGDILRRTTSGSFGDMRITNFSSSSSRYRVRIRYASTTDLQFFLSVGGTPVNVADFPKTIDRGENLEYGSFRTAGFTTPFSFVSSTNNFTLGVQSVSSGNEIFVDRIEFVPADATFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 104 - DNA, 3612 bp, Artificial
  Chimeric coding sequence encoding TIC861.
atgaaactaaagaatccagataagcatcaaagtttttctagcaatgcgaaagtagataaaatctctacggattcactaaaaaatgaaacagatatagaattacaaaacattaatcatgaagattgtttgaaaatatctgagtatgaaaatgtagagccgtttgttagtgcatcaacaattcaaacaggtattagtattgcgggtaaaatacttggcaccctaggcgttccttttgcaggacaagtagctagtctttatagttttatcttaggtgagctatggcctaaggggaaaaatcaatgggaaatctttatggaacatgtagaagagattattaatcaaaaaatatcaacttatgcaagaaataaagcacttacagacttgaaaggattaggagatgccttagctgtctaccatgaatcgcttgaaagttgggttggaaatcgtaagaacacaagggctaggagtgttgtcaagagccaatatatcgcattagaattgatgttcgttcagaaactaccttcttttgcagtgtctggagaggaggtaccattattaccgatatatgcccaagctgcaaatttacatttgttgctattaagagatgcatctatttttggaaaagagtggggattatcatcttcagaaatttcaacattttataaccgtcaagtcgaacgagcaggagattattccgaccattgtgtgaaatggtatagtacaggtctaaataacttgaggggtacaaatgccgaaagctgggttcgttataatcaatttcgtaaagatatgacattaatggtacttgatttagtcgcactattcccaagctatgatacacttgtatatccaattaaaactacttctcaacttacaagagaagtatatacagacgcaattgggacagtacatccgaatgcaagttttgcaagtacgacttggtataataataatgccccttcgttctctaccatagagtctgctgttgttcgaaacccgcatctactcgattttctagaacaagttacaatttacagcttattaagtaggtggagtaacactcagtatatgaatatgtggggaggacatagacttgaattccgaacaatcggaggaatgttaaatacctcaacacaaggatctactaatacttctattaatcctgtaacattaccgttcacgtctcgagacgtctataggactgaatcattggcagggctgaatctatttttaactcaacctgttaatggagtacctagggttgattttcattggaaattcgtcacacatccgatcgcatctgataatttctattatccagggtatgctggaattgggacgcaattacaagattcagaaaatgaattaccacctgaaacaacaggacagccaaattatgaatcatatagtcatagattatctcatataggactcatttcagcatcccatgtgaaagcattggtatattcttggacgcatcgtagtgcagatcgtacaaacacaattgatccagagagaattaatcaaatacctttagtgaaaggatttagagtttgggggggcacctctgtcattacaggaccaggatttacaggaggggatatccttcgaagaaatacctttggtgattttgtatctctacaagtcaatattaattcaccaattacccaaagataccgtttaagatttcgttacgcttccagtagggatgcacgagttatagtattaacaggagcggcatccacaggagtgggaggccaagttagtgtaaatatgcctcttcagaaaactatggaaataggggagaacttaacatctagaacatttagatataccgattttagtaatcctttttcatttagagctaatccagatataattgggataagtgaacaacctctatttggtgcaggttctattagtagcggtgaactttatatagataaaattgaaattattctagcagatgcaacatttgaagcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 105 - protein, 1203 aa, Artificial
  Amino acid sequence of the chimeric protein TIC861.
MKLKNPDKHQSFSSNAKVDKISTDSLKNETDIELQNINHEDCLKISEYENVEPFVSASTIQTGISIAGKILGTLGVPFAGQVASLYSFILGELWPKGKNQWEIFMEHVEEIINQKISTYARNKALTDLKGLGDALAVYHESLESWVGNRKNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRKDMTLMVLDLVALFPSYDTLVYPIKTTSQLTREVYTDAIGTVHPNASFASTTWYNNNAPSFSTIESAVVRNPHLLDFLEQVTIYSLLSRWSNTQYMNMWGGHRLEFRTIGGMLNTSTQGSTNTSINPVTLPFTSRDVYRTESLAGLNLFLTQPVNGVPRVDFHWKFVTHPIASDNFYYPGYAGIGTQLQDSENELPPETTGQPNYESYSHRLSHIGLISASHVKALVYSWTHRSADRTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 106 - DNA, 3432 bp, Artificial
  Chimeric coding sequence encoding TIC848.
atggagataaataatcagaagcaatgcataccatataattgcttaagtaatcctgaggaagtacttttggatggggagaggatattacctgatatcgatccactcgaagtttctttgtcgcttttgcaatttcttttgaataactttgttccagggggaggctttatttcaggattagttgataaaatatggggggctttgagaccatctgaatgggacttatttcttgcacagattgaacggttgattgatcaaagaatagaagcaacagtaagagcaaaagcaatcactgaattagaaggattagggagaaattatcaaatatacgctgaagcatttaaagaatgggaatcagatcctgataacgaagcggctaaaagtagagtaattgatcgctttcgtatacttgatggtctaattgaagcaaatatcccttcatttcggataattggatttgaagtgccacttttatcggtttatgttcaagcagctaatctacatctcgctctattgagagattctgttatttttggagagagatggggattgacgacaaaaaatgtcaatgatatctataatagacaaattagagaaattcatgaatatagcaatcattgcgtagatacgtataacacagaactagaacgtctagggtttagatctatagcgcagtggagaatatataatcagtttagaagagaactaacactaactgtattagatattgtcgctcttttcccgaactatgacagtagactgtatccgatccaaactttttctcaattgacaagagaaattgttacatccccagtaagcgaattttattatggtgttattaatagtggtaatataattggtactcttactgaacagcagataaggcgaccacatcttatggacttctttaactccatgatcatgtatacatcagataatagacgggaacattattggtcaggacttgaaatgacggcttattttacaggatttgcaggagctcaagtgtcattccctttagtcgggactagaggggagtcagctccaccattaactgttagaagtgttaatgatggaatttatagaatattatcggcaccgttttattcagcgccttttctaggcaccattgtattgggaagtcgtggagaaaaatttgattttgcgcttaataatatttcacctccgccatctacaatatacagacatcctggaacagtagattcactagtcagtataccgccacaggataatagcgtaccaccgcacaggggatctagtcatcgattaagtcatgttacaatgcgcgcaagttcccctatattccattggacgcatcgcagcgcaaccactacaaatacaattaatccaaatgctattatccaaataccactagtaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctaccacaaatttacaattccatacatcaattgacggaagacctattaatcaggggaatttttcagcaactatgagtagtgggagtaatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 107 - protein, 1143 aa, Artificial
  Amino acid sequence of the chimeric protein TIC848.
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRIIGFEVPLLSVYVQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKSTNLGSGTSVVKGPGFTGGDILRRTSPGQISTLRVNITAPLSQRYRVRIRYASTTNLQFHTSIDGRPINQGNFSATMSSGSNLQSGSFRTVGFTTPFNFSNGSSVFTLSAHVFNSGNEVYIDRIEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 108 - DNA, 3429 bp, Artificial
  Chimeric coding sequence encoding TIC849.
atggagataaataatcagaagcaatgcataccatataattgcttaagtaatcctgaggaagtacttttggatggggagaggatattacctgatatcgatccactcgaagtttctttgtcgcttttgcaatttcttttgaataactttgttccagggggaggctttatttcaggattagttgataaaatatggggggctttgagaccatctgaatgggacttatttcttgcacagattgaacggttgattgatcaaagaatagaagcaacagtaagagcaaaagcaatcactgaattagaaggattagggagaaattatcaaatatacgctgaagcatttaaagaatgggaatcagatcctgataacgaagcggctaaaagtagagtaattgatcgctttcgtatacttgatggtctaattgaagcaaatatcccttcatttcggataattggatttgaagtgccacttttatcggtttatgttcaagcagctaatctacatctcgctctattgagagattctgttatttttggagagagatggggattgacgacaaaaaatgtcaatgatatctataatagacaaattagagaaattcatgaatatagcaatcattgcgtagatacgtataacacagaactagaacgtctagggtttagatctatagcgcagtggagaatatataatcagtttagaagagaactaacactaactgtattagatattgtcgctcttttcccgaactatgacagtagactgtatccgatccaaactttttctcaattgacaagagaaattgttacatccccagtaagcgaattttattatggtgttattaatagtggtaatataattggtactcttactgaacagcagataaggcgaccacatcttatggacttctttaactccatgatcatgtatacatcagataatagacgggaacattattggtcaggacttgaaatgacggcttattttacaggatttgcaggagctcaagtgtcattccctttagtcgggactagaggggagtcagctccaccattaactgttagaagtgttaatgatggaatttatagaatattatcggcaccgttttattcagcgccttttctaggcaccattgtattgggaagtcgtggagaaaaatttgattttgcgcttaataatatttcacctccgccatctacaatatacagacatcctggaacagtagattcactagtcagtataccgccacaggataatagcgtaccaccgcacaggggatctagtcatcgattaagtcatgttacaatgcgcgcaagttcccctatattccattggacgcatcgcagcgcaaccactacaaatacaattaatccaaatgctattatccaaataccactagtaaaagcatttaaccttcattcaggtgccactgttgttagaggaccagggtttacaggtggagatatccttcgtagaacaaatacgggtacatttggagatatacgattaaatattaatgtgccattatcccaaagatatcgcgtaaggattcgttatgcttctactacagatttacaatttttcacgagaattaatggaaccactgttaatattggtaatttctcaagaactatgaataggggggataatttagaatatagaagttttagaactgcaggatttagtactccttttaattttttaaatgcccaaagcacattcacattgggtgctcagagtttttcaaatcaggaagtttatatagatagagtcgaatttgttccagcagaggtaacatttgaggcagaatatgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 109 - protein, 1142 aa, Artificial
  Amino acid sequence of the chimeric protein TIC849.
MEINNQKQCIPYNCLSNPEEVLLDGERILPDIDPLEVSLSLLQFLLNNFVPGGGFISGLVDKIWGALRPSEWDLFLAQIERLIDQRIEATVRAKAITELEGLGRNYQIYAEAFKEWESDPDNEAAKSRVIDRFRILDGLIEANIPSFRIIGFEVPLLSVYVQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKAFNLHSGATVVRGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 110 - DNA, 3570 bp, Artificial
  Chimeric coding sequence encoding TIC847.
atgacttcaaataggaaaaatgagaatgaaattataaatgctttatcgattccaacggtatcgaatccttccacgcaaatgaatctatcaccagatgctcgtattgaagatagcttgtgtgtagccgaggtgaacaatattgatccatttgttagcgcatcaacagtccaaacgggtataaacatagctggtagaatattgggcgtattaggtgtgccgtttgctggacaactagctagtttttatagttttcttgttggggaattatggcctagtggcagagatccatgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcagatatacagaggaatattctaaccattgcgtacaatggtataatacagggctaaataacttaagagggacaaatgctgaaagttggttgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgagacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcagatcgtacgaatacgattggaccaaatagaattacacaaataccattggtaaaggcgcataccctccaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacctaagaatttacgtaacggttgcaggtgaacgaatttttgctggtcaatttgacaaaactatggatgctggtgccccattaacattccaatcttttagttacgcaactattaatacagcttttacattcccagaaagatcgagcagcttgactgtaggtgccgatacgtttagttcaggtaatgaagtttatgtagatagatttgaattaatcccagttactgcaaccttcgaggcagaatctgatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtgcccatcattcccatcatttctccttggacattgatgttggatgtacagacttaaatgaggacttaggtgtatgggtgatattcaagattaagacgcaagatggccatgcaagactaggaaatctagaatttctcgaagagaaaccattagtaggagaagcactagctcgtgtgaaaagagcggagaaaaaatggagagacaaacgtgaaaaattggaatgggaaacaaatattgtttataaagaggcaaaagaatctgtagatgctttatttgtaaactctcaatatgatagattacaagcggataccaacatcgcgatgattcatgcggcagataaacgcgttcatagcattcgagaagcttatctgcctgagctgtctgtgattccgggtgtcaatgcggctatttttgaagaattagaagggcgtattttcactgcattctccctatatgatgcgagaaatgtcattaaaaatggtgattttaataatggcttatcctgctggaacgtgaaagggcatgtagatgtagaagaacaaaacaaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcatatacagatggacgaagagacaatccttgtgaatctaacagaggatatggggattacacaccactaccagctggctatgtgacaaaagaattagagtacttcccagaaaccgataaggtatggattgagatcggagaaacggaaggaacattcatcgtggacagcgtggaattacttcttatggaggaatag

SEQ ID NO: 111 - protein, 1189 aa, Artificial
  Amino acid sequence of the chimeric protein TIC847.
MTSNRKNENEIINALSIPTVSNPSTQMNLSPDARIEDSLCVAEVNNIDPFVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSADRTNTIGPNRITQIPLVKAHTLQSGTTVVKGPGFTGGDILRRTSGGPFAFSNVNLDFNLSQRYRARIRYASTTNLRIYVTVAGERIFAGQFDKTMDAGAPLTFQSFSYATINTAFTFPERSSSLTVGADTFSSGNEVYVDRFELIPVTATFEAESDLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCAHHSHHFSLDIDVGCTDLNEDLGVWVIFKIKTQDGHARLGNLEFLEEKPLVGEALARVKRAEKKWRDKREKLEWETNIVYKEAKESVDALFVNSQYDRLQADTNIAMIHAADKRVHSIREAYLPELSVIPGVNAAIFEELEGRIFTAFSLYDARNVIKNGDFNNGLSCWNVKGHVDVEEQNNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 112 - DNA, 3588 bp, Artificial
  Synthetic DNA sequence for expression in plants encoding TIC713.
atggataacaacccaaacatcaacgaatgcattccgtacaactgcctgagcaaccctgaggtggaggtgctaggtggcgagcgcatcgaaacgggttacacgccgattgacatctccctgtccctcacccagttcctccttagcgagttcgtgccgggcgcgggtttcgtgctgggcctcgttgacatcatctgggggatcttcggtccctcccaatgggatgcgttcctggtgcagatcgagcagcttatcaaccagcggatcgaagagttcgctaggaaccaggccatcagccgcctcgaaggtctcagcaacctctatcaaatctacgctgagtccttccgcgagtgggaggcggaccccaccaaccctgccctccgcgaggaaatgcgtatccaattcaatgacatgaacagcgccctgaccacggcgatcccgctgctggccgtccagaactaccaggtccccctgctcagcgtctacgtccaggccgctaacctccacctcagcgtgctgcgcgacgtctccgtcttcggccagaggtgggggttcgacgcggcgacgatcaacagccgctacaacgacctgacccggctgatcgggaactacacggactacgctgtccggtggtacaacaccggcctggagcgcgtgtggggaccagactcccgtgactgggtccggtacaaccagttccgtagggaactcactctgacggtcctggacatcgtggctctgttcccgaactacgacagccgccgctaccccatccggactgtgtcccaactgacccgcgaaatctacacgaaccctgtccttgagaacttcgatgggagcttccgtggctccgcccagggcatcgagcgctccatccgctccccgcacctcatggacatcctcaactccatcacgatctacaccgacgcccatcgcggctactattactggtccggccaccagatcatggccagccccgtgggcttctccggccccgagttcaccttcccgctctacggcacgatgggcaacgccgctcctcagcaacgcatcgtggcccagctcggccagggcgtgtacaggaccctctccagcaccctctacaggcgtcctttcaacatcggcatcaacaatcagcaactctccgtgctcgacgggactgagttcgcctacggcaccagcagcaacctgcctagcgccgtgtaccgcaagagcggcaccgtggacagcctggacgagatccctccgcagaacaacaacgtgcctccgaggcaaggcttcagccacaggctgagccacgtgagcatgttccgtagcggcttcagcaacagctctgtgagcatcatcagggccccgatgttctcctggattcacaggagcgccgagttcaacaataccatcggcccgaacaggatcacccagatccctctggtgaaggccctgaacctgcactctggcgtcaccgtcgttggcggtcctggcttcaccggtggggacatcctgaggcgtaccaacaccggaaccttcggtgacatcaggctgaacatcaacgtccctctgtctcagaggtacagggtcaggatcaggtacgcctctaccactgaccttcagttctttaccaggatcaacggtactactgtcaacatcggtaacttcagccgcactatgaacaggggtgacaacctggagtaccgtagtttccgtactgctggattctctactcctttcaacttcctgaacgctcagtctactttcactctgggtgctcagtctttctcgaaccaggaggtctacatcgaccgtgtcgagttcgtcccggctgaggtcactttcgaggctgagtacgacctggagcgcgctcaaaaggctgtcaacgctctgttcacttctactaacccgcgcagactgaagactgacgtcactgactaccacatcgaccaagtctcgaacatggtcgcttgcctgtctgacgagttctgcctggacgagaagcgtgagctgttcgagaaggtcaagtacgctaagcgtctgtctgacgagcgtaacctgctccaggacccgaacttcactttcatctcgggtcaactgtcgtttgctagtattgacggtcagtcgaactttccgtcgattaacgagctgtcggagcacggttggtggggtagtgctaacgtcactatccaggagggtaacgacgtctttaaggagaactacgtcactctgccgggtactttcaacgagtgctacccgaactacctttaccagaagattggtgagtcggagcttaaggcttacactcgttaccagcttcgtggttacattgaggactcgcaggaccttgaaatctaccttattcggtacaatgccaaacacgagactcttgacgtccctgggacggatagtctttggccgctttcggtcgagtcgccgattgggcggtgcggggagccgaatcgttgcgctccgcactttgagtggaatccagaccttgattgctcatgccgggatggggagcggtgcgctcaccatagtcaccactttacgcttgatattgatgtcgggtgcacggatcttcacgagaatcttggggtctgggtcgtgtttaagattaagacgcaagaggggtacgcgcggcttgggaatcttgagtttattgaggaaaagccacttattggtgaggcgctttcacgggtcaagcgggcggaaaagaaatggagggataagcgggagaagctccaattggagacgaagcgggtctacacggaggcgaaggaggcggtcgatgcgctgtttgtcgatagtcaatacgatcaattgcaagcggatacgaacattgggatgattcacgcggcagataagttggtccaccggattagagaggcgtacttgtcagagttgccagtcattccaggggttaatgcggagattttcgaggaattggaggggcacatcataacggcgatgagtctgtacgatgcgagaaatgttgtaaagaatggtgatttcaacaatgggttgacgtgctggaatgttaagggccacgttgatgttcaacaatcacatcatcggtcggatctcgttattccagagtgggaggcggaggtttcacaagcagttagagtttgcccagggagaggttacatcctaagagttacggcatacaaggagggctatggagaaggatgcgttacgatccatgagattgagaacaatacggatgagctaaagtttaagaattgtgaggaagaagaagtttacccaacggatacgggaacatgcaacgattacacagcacatcaaggaacagcagcatgtaattcacgaaatgccgggtatgaagatgcttacgaagttgatacaacagcatcagttaattacaagccaacatacgaagaagaaacatacacagatgttcgacgagataatcattgtgagtatgatcgagggtatgtaaattatccaccagttccagccgggtatgtcacaaaggaactagaatactttccagaaacagatacagtatggatagagatcggagaaacagaaggaaagttcatagtggactcagtagaactattactgatggaagaatga

SEQ ID NO: 113 - DNA, 3588 bp, Artificial
  Synthetic DNA sequence for expression in plants encoding TIC713.
atggataacaacccaaacatcaacgaatgcattccgtacaactgcctgagcaaccctgaggtggaggtgctaggtggcgagcgcatcgaaacgggttacacgccgattgacatctccctgtccctcacccagttcctccttagcgagttcgtgccgggcgcgggtttcgtgctgggcctcgttgacatcatctgggggatcttcggtccctcccaatgggatgcgttcctggtgcagatcgagcagcttatcaaccagcggatcgaagagttcgctaggaaccaggccatcagccgcctcgaaggtctcagcaacctctatcaaatctacgctgagtccttccgcgagtgggaggcggaccccaccaaccctgccctccgcgaggaaatgcgtatccaattcaatgacatgaacagcgccctgaccacggcgatcccgctgctggccgtccagaactaccaggtccccctgctcagcgtctacgtccaggccgctaacctccacctcagcgtgctgcgcgacgtctccgtcttcggccagaggtgggggttcgacgcggcgacgatcaacagccgctacaacgacctgacccggctgatcgggaactacacggactacgctgtccggtggtacaacaccggcctggagcgcgtgtggggaccagactcccgtgactgggtccggtacaaccagttccgtagggaactcactctgacggtcctggacatcgtggctctgttcccgaactacgacagccgccgctaccccatccggactgtgtcccaactgacccgcgaaatctacacgaaccctgtccttgagaacttcgatgggagcttccgtggctccgcccagggcatcgagcgctccatccgctccccgcacctcatggacatcctcaactccatcacgatctacaccgacgcccatcgcggctactattactggtccggccaccagatcatggccagccccgtgggcttctccggccccgagttcaccttcccgctctacggcacgatgggcaacgccgctcctcagcaacgcatcgtggcccagctcggccagggcgtgtacaggaccctctccagcaccctctacaggcgtcctttcaacatcggcatcaacaatcagcaactctccgtgctcgacgggactgagttcgcctacggcaccagcagcaacctgcctagcgccgtgtaccgcaagagcggcaccgtggacagcctggacgagatccctccgcagaacaacaacgtgcctccgaggcaaggcttcagccacaggctgagccacgtgagcatgttccgtagcggcttcagcaacagctctgtgagcatcatcagggccccgatgttctcctggattcacaggagcgccgagttcaacaataccatcggcccgaacaggatcacccagatccctctggtgaaggccctgaacctgcactctggcgtcaccgtcgttggcggtcctggcttcaccggtggggacatcctgaggcgtaccaacaccggaaccttcggtgacatcaggctgaacatcaacgtccctctgtctcagaggtacagggtcaggatcaggtacgcctctaccactgaccttcagttctttaccaggatcaacggtactactgtcaacatcggtaacttcagccgcactatgaacaggggtgacaacctggagtaccgtagtttccgtactgctggattctctactcctttcaacttcctgaacgctcagtctactttcactctgggtgctcagtctttctcgaaccaggaggtctacatcgaccgtgtcgagttcgtcccggctgaggtcactttcgaggctgagtacgacctggagcgcgctcaaaaggctgtcaacgctctgttcacttctactaacccgcgcagactgaagactgacgtcactgactaccacatcgaccaagtctcgaacatggtcgcttgcctgtctgacgagttctgcctggacgagaagcgtgagctgttcgagaaggtcaagtacgctaagcgtctgtctgacgagcgtaacctgctccaggacccgaacttcactttcatctcgggtcaactgtcgtttgctagtattgacggtcagtcgaactttccgtcgattaacgagctgtcggagcacggttggtggggtagtgctaacgtcactatccaggagggtaacgacgtctttaaggagaactacgtcactctgccgggtactttcaacgagtgctacccgaactacctttaccagaagattggtgagtcggagcttaaggcttacactcgttaccagcttcgtggttacattgaggactcgcaggaccttgaaatctaccttattcggtacaatgccaaacacgagactcttgacgtccctgggacggatagtctttggccgctttcggtcgagtcgccgattgggcggtgcggggagccgaatcgttgcgctccgcactttgagtggaatccagaccttgattgctcatgccgggatggggagcggtgcgctcaccatagtcaccactttacgcttgatattgatgtcgggtgcacggatcttcacgagaatcttggggtctgggtcgtgtttaagattaagacgcaagaggggtacgcgcggcttgggaatcttgagtttattgaggaaaagccacttattggtgaggcgctttcacgggtcaagcgggcggaaaagaaatggagggataagcgggagaagctccaattggagacgaagcgggtctacacggaggcgaaggaggcggtcgatgcgctgtttgtcgatagtcaatacgatcaattgcaagcggatacgaacattgggatgattcacgcggcagataagttggtccaccggattagagaggcgtacttgtcagagttgccagtcattccaggggttaatgcggagattttcgaggaattggaggggcacatcataacggcgatgagtctgtacgatgcgagaaatgttgtaaagaatggtgatttcaacaatgggttgacgtgctggaatgttaagggccacgttgatgttcaacaatcacatcatcggtcggatctcgttattccagagtgggaggcggaggtttcacaagcagttagagtttgcccagggagaggttacatcctaagagttacggcatacaaggagggctatggagaaggatgcgttacgatccatgagattgagaacaatacggatgagctaaagtttaagaattgtgaggaagaagaagtttacccaacggatacgggaacatgcaacgattacacagcacatcaaggaacagcagcatgtaattcacgaaatgccgggtatgaagatgcttacgaagttgatacaacagcatcagttaattacaagccaacatacgaagaagaaacatacacagatgttcgacgagataatcattgtgagtatgatcgagggtatgtaaattatccaccagttccagccgggtatgtcacaaaggaactagaatactttccagaaacagatacagtatggatagagatcggagaaacagaaggaaagttcatagtggactcagtagaactattactgatggaagaatag

SEQ ID NO: 114 - DNA, 3531 bp, Artificial
  Synthetic DNA sequence for expression in plants encoding TIC843.
atggataacaacccaaacatcaacgaatgcattccgtacaactgcctgagcaaccctgaggtggaggtgctaggtggcgagcgcatcgaaacgggttacacgccgattgacatctccctgtccctcacccagttcctccttagcgagttcgtgccgggcgcgggtttcgtgctgggcctcgttgacatcatctgggggatcttcggtccctcccaatgggatgcgttcctggtgcagatcgagcagcttatcaaccagcggatcgaagagttcgctaggaaccaggccatcagccgcctcgaaggtctcagcaacctctatcaaatctacgctgagtccttccgcgagtgggaggcggaccccaccaaccctgccctccgcgaggaaatgcgtatccaattcaatgacatgaacagcgccctgaccacggcgatcccgctgctggccgtccagaactaccaggtccccctgctcagcgtctacgtccaggccgctaacctccacctcagcgtgctgcgcgacgtctccgtcttcggccagaggtgggggttcgacgcggcgacgatcaacagccgctacaacgacctgacccggctgatcgggaactacacggactacgctgtccggtggtacaacaccggcctggagcgcgtgtggggaccagactcccgtgactgggtccggtacaaccagttccgtagggaactcactctgacggtcctggacatcgtggctctgttcccgaactacgacagccgccgctaccccatccggactgtgtcccaactgacccgcgaaatctacacgaaccctgtccttgagaacttcgatgggagcttccgtggctccgcccagggcatcgagcgctccatccgctccccgcacctcatggacatcctcaactccatcacgatctacaccgacgcccatcgcggctactattactggtccggccaccagatcatggccagccccgtgggcttctccggccccgagttcaccttcccgctctacggcacgatgggcaacgccgctcctcagcaacgcatcgtggcccagctcggccagggcgtgtacaggaccctctccagcaccctctacaggcgtcctttcaacatcggcatcaacaatcagcaactctccgtgctcgacgggactgagttcgcctacggcaccagcagcaacctgcctagcgccgtgtaccgcaagagcggcaccgtggacagcctggacgagatccctccgcagaacaacaacgtgcctccgaggcaaggcttcagccacaggctgagccacgtgagcatgttccgtagcggcttcagcaacagctctgtgagcatcatcagggccccgatgttctcctggattcacaggagcgccgagttcaacaataccatcggcccgaacaggatcacccagatccctctggtgaaggccctgaacctgcactctggcgtcaccgtcgttggcggtcctggcttcaccggtggggacatcctgaggcgtaccaacaccggaaccttcggtgacatcaggctgaacatcaacgtccctctgtctcagaggtacagggtcaggatcaggtacgcctctaccactgaccttcagttctttaccaggatcaacggtactactgtcaacatcggtaacttcagccgcactatgaacaggggtgacaacctggagtaccgtagtttccgtactgctggattctctactcctttcaacttcctgaacgctcagtctactttcactctgggtgctcagtctttctcgaaccaggaggtctacatcgaccgtgtcgagttcgtcccggctgaggtcactttcgaggctgagtacgaccttgagagagcgcagaaggccgtgaacgcgctgttcacctcgactaaccagttgggactcaagacaaatgtcactgactaccacatcgaccaagtgagtaatctcgttacctacctgtcggacgagttctgcctggatgagaagagggaactgtctgagaaagtgaagcacgcaaagcgcctctcggatgagaggaacctcctccaggattccaacttcaaggacatcaaccggcagccggaaagaggctggggtggctccaccggcattactatccagggcggcgacgatgtgttcaaggagaactacgtcacactctcaggcactttcgacgagtgttacccgacgtacctgtaccagaagattgatgagtccaagctgaaggcattcacccgctatcagcttcgcggttacattgaagattcccaggaccttgagatctacctcatcaggtacaacgccaagcacgagacggtcaacgtgcccggcacgggttccctgtggccgttgtctgcccaatctcccatcgggaagtgcggtgagccgaaccgttgcgccccgcacctggagtggaaccctgacctggattgctcctgtagggatggcgagaagtgcgctcaccattcccaccacttctcgctggacatcgacgtggggtgcacggatctcaacgaggatctcggagtctgggtcatcttcaagatcaagacgcaggacggacacgctcgcctcggcaatctggagtttcttgaggaaaagccgctcgtaggtgaggcgctcgccagggtaaagcgcgcggagaagaagtggagggataagcgtgagaaacttgaatgggagacaaacatcgtctacaaggaagcaaaggagtcagttgatgcactgttcgtcaactctcagtatgaccagttgcaggccgataccaacatcgcgatgatccacgccgctgacaagcgcgttcactcgatccgcgaggcgtacctccctgagctttccgtcatcccaggcgtcaatgcggccatcttcgaggaacttgagggccggatcttcaccgctttctcgctctacgacgctagaaacgtcatcaagaacggcgacttcaacaatggcctgagctgctggaatgtgaagggtcatgtggatgtcgaagagcagaacaatcagcgttctgtgctcgtggtccccgaatgggaagctgaggtttcccaagaagtgagagtgtgcccaggacgcggttacattctccgtgttacggcgtacaaggagggctatggcgaaggctgcgtgaccattcatgagatcgagaacaacacggatgagctgaagttctcaaactgcgtcgaggaagaaatctaccctaacaacactgtgacctgtaacgactacacggtgaaccaggaagagtacggcggcgcttacactagccgcaaccgtgggtacaacgaggccccatcggtccctgctgactacgcatccgtctacgaggagaagtcttacactgacgggagacgggagaacccctgcgagttcaaccggggttacagggattacacgcctctgcccgttggctatgtcactaaggagctggagtatttcccggagactgataaagtctggatcgagatcggggagactgaagggactttcatcgtcgattccgtggagctgcttctgatggaggagtga

SEQ ID NO: 115 - DNA, 3501 bp, Artificial
  Synthetic DNA sequence for expression in plants encoding TIC862.
atggacaacaacccgaacatcaacgagtgcatcccgtacaactgcctgagcaaccctgaggtggaggtgctaggcggtgagcgcatcgagaccggctacacgcctatcgacatctccctgagcctgacccagttcctccttagcgagttcgtgcccggcgcgggcttcgtgctcggcctcgtggacatcatctggggcatcttcggcccgtcccagtgggacgccttcctcgtgcagatcgagcagctcatcaaccagcgcatcgaggagttcgcccgcaaccaggccatctcccgcctggagggcctctccaacctctaccagatctacgccgagtccttccgcgagtgggaggccgacccgaccaacccggccctccgcgaggaaatgcgtatccagttcaacgacatgaactccgccctcaccactgccatcccgctcctggccgtgcagaactaccaagtgcctctcctgtccgtgtacgtccaagctgcgaacctccacctctccgtgctgcgcgacgtctccgtcttcggccagcgctggggcttcgacgctgcgaccatcaactcccgctacaacgacctgacccgcctgatcggcaactacaccgactacgctgtccgctggtacaacaccggcctggagcgcgtctggggccctgactccagggactgggtccgctacaaccagttccgccgggagctgaccctgactgtcctggacatcgtcgctctgttccctaactacgatagccgccgctaccctatcaggactgtcagccagcttactagggaaatctacactaaccctgtccttgagaacttcgatggttccttccgtggtagcgctcagggtattgagcggagcattcggagcccgcaccttatggacattcttaactctattactatctacacggatgctcaccgtggttactattactggtctggtcaccagattatggctagtccggtcggtttctctgggccggagttcacgttcccgctttatgggacgatgggcaacgcggcaccgcagcaacgtattgtggcgcagcttgggcaaggcgtttatcgtacgctttcttcgacattgtacagacgtccgtttaacattgggatcaataaccagcaattgtctgttctggatggaacagaatttgcgtatggaacatcttcgaatttgccatctgcggtttatcgtaagtctggaacagttgacagtctcgatgagattccaccacagaacaacaacgttccaccaagacagggattcagtcacagattaagccacgttagtatgtttagatcaggcttctcgaactcatcagtatcaatcatacgagcaccaatgttctcgtggatacaccgctcggcagagttcaacaacatcatcgcctccgacagcatcacccagatcccggccgtgaagggcaacttcctcttcaacggctccgtcatctccggccctggcttcaccggcggcgatctcgtgcgctgcacgaatggttccggcctcaccctgtacgtgacgcctgcgcccgacctcacctactccaagacctacaagattcgcattcgctatgcctccacctcccaagtgcgctttggcatcgacctcggctcctacactcactccatctcctacttcgacaagacgatggacaaaggcaacaccctcacctacaactccttcaacctctcctccgtgtcccgccctatcgagatcagcggcggcaacaagatcggtgtctcggtcggcggcatcggctctggcgacgaggtgtacatcgacaagatcgagttcatcccgatggagcgcgcccagaaggccgtgaacgccctcttcactagcactaaccagctcggcctcaagactaacgtgaccgactaccacattgaccaagtgagcaacctagtgacctaccttagcgacgagttctgccttgacgagaagcgtgagctgagcgagaaggtgaagcacgccaagcgcctctccgacgagcgcaacctcctccaggactccaacttcaaggacatcaaccgccagcccgagcgcggctggggcggtagcaccggcatcaccatccagggcggtgacgatgtgttcaaggagaactacgtgaccctctccggcaccttcgacgagtgctacccgacctacctctaccagaagatcgacgagtccaagctcaaggcgttcacccgctaccagcttcgcggctacatcgaggactcccaggatctggagatctacctcatccgctacaacgccaagcacgagaccgtgaacgtgcccggcaccggctccctctggccgctctccgcccagagccctatcggcaagtgcggcgagcccaaccgctgcgcgcctcacctggagtggaaccctgacctcgactgctcctgccgcgacggcgagaagtgcgcccaccatagccaccacttctctctcgacatcgacgtgggctgcaccgacctcaacgaggatctgggcgtgtgggtgatcttcaagatcaagacccaggacggccacgccaggctgggcaacctggagttcctggaggagaagcctctggtgggtgaggccctggccagggtcaagagggctgagaagaaatggagggacaagagggagaagctggagtgggagaccaacatcgtgtacaaggaggctaaggagtccgtggacgctctgttcgtcaactctcagtacgatcagctccaggctgacaccaacatcgctatgatccacgctgcggataagagggtccactctatcagggaggcttacctgcctgagctttctgtcatccctggtgtcaacgcggcaatcttcgaggaacttgagggccgcatcttcactgcgttctcgctttacgatgcgcggaacgtcattaagaacggtgacttcaacaatggtctttcgtgctggaacgtcaagggtcatgtcgatgtcgaggaacagaacaaccagcggtcggtccttgtcgttcccgagtgggaggccgaggtctcgcaagaggtccgggtctgccctgggcgcgggtacattcttcgtgtcactgcgtacaaggagggctacggcgagggctgcgttactattcatgagattgagaacaatacggatgagcttaagtttagtaactgtgttgaggaggagatctacccgaacaatacggttacgtgcaatgattacacggtgaaccaggaggaatacggcggagcatacacctcacgtaatagagggtacaatgaggcaccgtcagttccggcagattatgcctcagtttatgaggagaagtcctacacggatggaagacgcgagaatccatgtgagtttaatagaggataccgagactacacaccactcccagttggatacgttacaaaggagttggaatacttcccagaaacagataaagtttggatagagatcggagaaacagaaggaaccttcatcgtggacagtgtagaactgctgctgatggaagaatga

SEQ ID NO: 116 - DNA, 3549 bp, Artificial
  Synthetic DNA sequence for expression in plants encoding TIC1099.
atggacaacaaccccaacatcaatgagtgcatcccttacaactgcctcagcaaccccgaggtggaggtgctcggcggtgagcggatcgagaccgggtacactcctatcgacatcagcctgtccctgacacagttccttctctccgagttcgtcccaggcgcgggctttgtcctgggccttgtggacatcatctggggaatcttcgggccatctcagtgggacgcgtttcttgtgcagatagagcaacttattaaccagaggatcgaggagttcgcgcgcaatcaggctatctcacgcctcgaagggctttccaatctgtaccagatctacgcggagtcgttccgggaatgggaggcggaccctaccaacccggcgctgcgcgaggaaatgaggatccagttcaacgatatgaactcggctctgaccacggccatccctctgctcgccgtgcagaattaccaagtcccgctcctttccgtgtacgtccaggctgccaacctccatctgtcggtcctccgtgacgtgagcgtgttcggtcagcgttggggcttcgatgccgcgactatcaacagccggtacaacgacttgactaggcttatcgggaactacacagactacgctgtcagatggtacaataccggcctggagagagtgtggggccccgactcccgcgactgggtgagatacaatcagttccgccgcgagcttaccctcactgtcctggacatcgtggccctcttcccaaattacgatagccgccgttacccgatcaggactgtgagtcagttgacccgtgaaatctacaccaacccggtcttggagaactttgacggttccttccggggttccgcacaaggaatcgagcggagcatccgctctccacacctgatggacatcctgaactcaattaccatctacacggatgcccaccgaggctactattactggagtggtcaccaaatcatggccagccctgtgggcttctcggggccggagttcacgttcccgctgtacggtacgatgggcaacgctgcacctcagcaaaggatcgttgcccaactgggtcagggcgtttacagaaccttgtcgagcacactgtaccggaggccgttcaacatcggcatcaataaccagcagctgagcgttctcgacggcacggagttcgcctacggaactagcagcaacctcccgagtgcagtgtaccggaagtccgggaccgtggatagcctggacgaaatcccacctcagaacaacaacgtccctcctcggcaaggcttctcccaccgccttagccatgtttccatgttccggtcgggattcagtaactccagcgtctctatcatcagggctcccatgttcagctggattcataggtccgctgagttcaacaacatcattgcctccgactcaatcactcagctccctctggtgaaggcgtctgcgccagtcagtggaaccaccgtactcaagggccccggcttcaccggcggcggaatccttcgtaggaccactaacggcactttcggtactctgcgtgtcactgtcaatagcccgctcactcagcgctaccgtgtaagggttcgattcgccagctccggcaacttctcaataaggatcttgcgcggaaacacatctatcgcataccagcgcttcggctcaacgatgaacaggggccaagagctgacttacgagagcttcgtgacctcagagttcaccactaaccagtccgatctacctttcaccttcacccaggctcaggagaacctcacaattcttgccgaaggcgtgagcactggcagtgagtatttcatcgaccggatcgagatcataccagtcaacccagcacgtgaggctgaggaagacctcgaacgcgcgcagaaggcagtcaacgccctctttaccagcaccaatcagttgggtcttaagacgaatgttaccgattaccatatcgaccaagttagtaatcttgttacatacctctctgatgagttctgcttggacgaaaagcgtgaactctccgagaaggtcaaacacgcgaagcgcctctctgatgagcgcaaccttctgcaagactcgaacttcaaggacattaacaggcaaccggaaagaggttggggcggtagtaccggcattacgatccagggcggagacgatgttttcaaggagaactacgttacccttagcggcacgtttgacgagtgctaccctacctatctctatcagaagatcgacgagagcaagctcaaggcgtttacccgttaccagctccgtggctacattgaggactctcaggatctcgaaatctacttgatccggtacaacgcgaagcacgagaccgtcaacgtccctgggacagggtcgctgtggcccctctctgcccaatctccgattggaaagtgcggcgagccaaaccggtgtgctcctcacctggagtggaatcccgatctggattgctcgtgcagggacggtgagaagtgtgcacaccattcacaccacttctccctcgacatcgacgtgggctgtacggatctgaacgaggatcttggggtttgggttatcttcaagattaagactcaggatggacacgcgcgcctcggcaacctggagttcctcgaggaaaagcctctcgtgggcgaggcgctggcccgcgttaagcgagctgagaagaagtggcgggacaaacgcgagaagctagagtgggaaacgaacatcgtttacaaggaagccaaggaatctgtggatgccctcttcgtgaactctcagtacgaccaactccaggccgacaccaacatcgccatgatccatgctgccgacaagcgcgtgcacagcatccgggaagcgtacctgcctgagctgagcgttattccgggtgtgaacgctgcgatcttcgaggaactcgaaggcagaatcttcaccgcattctccctgtacgatgctaggaatgttatcaagaacggggacttcaacaatgggctctcctgttggaacgttaagggccatgtggacgtggaggaacagaataaccagaggtctgtcctcgtggtccctgagtgggaggctgaggtttcacaggaggttcgggtctgcccgggtagggggtacattctccgggttaccgcctacaaggagggctacggcgagggctgtgtgaccatacacgagatcgagaataacaccgatgagttgaagtttagcaactgcgtcgaggaggaaatctaccccaacaatacggttacctgcaacgactacactgtcaaccaggaggagtatggcggagcttacacatcccggaaccgaggctacaacgaggccccatctgtcccggcggactatgcgtcggtgtacgaggagaagtcctacaccgatggccgtagggagaatccgtgcgagtttaaccgtggctaccgcgactacacgcctttgcccgtcggttatgtcactaaggaactggaatactttcccgagacggacaaggtgtggattgagatcggtgagactgagggcacgtttatcgttgactcggtggagctgttgctcatggaggagtga

SEQ ID NO: 117 - DNA, 3534 bp, Artificial
  Synthetic DNA sequence for expression in plants encoding TIC1103.
atggacaacaacccgaacatcaacgagtgcatcccgtacaactgcctgagcaacccggaggttgaggtgctgggcggtgagcgcatcgagaccggctacacgcctatcgacatctccctgagcctgacccagttcctccttagcgagttcgtgccgggcgcgggcttcgtgctcggcctcgtggacatcatctggggcatcttcggcccgtcccagtgggacgccttcctcgtgcagatcgagcagctcatcaaccagcgcatcgaggagttcgcccgcaaccaggccatctcccgcctggagggtctgtccaacctctaccaaatctacgccgagtccttccgcgagtgggaggccgacccgaccaacccggccctccgcgaggagatgcggattcagttcaacgacatgaactccgccctcaccaccgccatcccgctcctggccgtgcagaactaccaagtgccgctcctgtccgtgtacgtgcaagccgcgaacctccacctctccgtgctccgcgacgtctccgtgttcggccagcgctggggcttcgacgccgcgaccatcaactcccgctacaacgacctcacccgcctcatcggcaactacaccgactacgccgtgcgctggtacaacaccggcctggagcgcgtgtggggcccggactcccgcgactgggtgcgctacaaccagttccgccgcgagctgaccctcaccgtgctcgacatcgtggccctcttcccgaactacgactccaggcgctacccgatccgcaccgtgtcccagctcacccgcgaaatctacaccaacccggtgctggagaacttcgacggctccttccggggctccgcccagggcatcgagcgctccatccgctccccgcacctcatggacatcctcaactccatcaccatctacaccgacgcccacaggggctactactactggtccggccaccagatcatggccagcccggtgggcttctccggcccggagttcaccttcccgctctacggcactatgggcaacgccgcgccccagcaaaggatcgtggcccagctcggccagggcgtgtaccgcaccctcagctctaccctgtacaggcggcccttcaacatcggcatcaacaaccagcaactgagcgtgctggacggcaccgagttcgcctacggcaccagcagcaacctgcccagcgccgtgtaccgcaagagcggcaccgtggacagcctggacgagatcccgccgcagaacaacaacgtgccgccgcgccagggcttcagccacaggctgagccacgtgagcatgttccgcagcggcttcagcaacagctctgtgagcatcatcagggctcccatgttctcctggattcacaggagcgcggagttcaacaacatcattgcgagcgactctatcacccagctcccgatggtgaaggcgaacgcgctgctgagcggcaccagcgtcatcaagggccctggcagcaccggcggggacatcctgaggcggacgtctgtgggcagggtcgggaacttcaaggtcaacgtcaacgggccgctgacgcagcgctacctggtccgcatccgctacgcgagcacgactgacctggacttctacgtttaccggggcggtacgactgtcagcaactaccggttcaacaagacgatgaacaagggcgcgtctctgacgtacgacatcttcaagttcgcgtctttcagcacgcccttcacgttcacgaagacgcaagacgagctggggatcagtatccagaacttcagcagcggcgaggaggtgtacattgaccggattgaggtcattcccgtcgggacgacttacgaggcggagacggacctggagcgggcgcagaaggcggtcaacgcgctgttcacgagcacgaaccagctcggcctcaagacgaacgtcactgactaccacattgaccaagtctcgaacctggtcacttacctgtcggacgagttctgcctggacgagaagcgggagctgtcggagaaggtcaagcacgcgaagcggctgtcggacgagcggaacctgctccaggactcgaacttcaaggacatcaaccggcagccagagcggggctggggcggcagcaccgggattactatccagggcggtgacgacgtctttaaggagaactacgtcactctttcgggcactttcgacgagtgctacccaacttacctttaccagaagattgacgagtcgaagctcaaggcgtttactcgctaccaacttcgcgggtacattgaggacagtcaggatcttgaaatctaccttatccgctacaacgcgaagcacgagactgtcaacgtcccagggactgggtcgctctggccactctcggctcaatcgccaattgggaagtgcggtgagccaaacagatgcgctccacaccttgagtggaatccagaccttgactgctcgtgcagagacggtgagaagtgcgctcaccatagtcatcacttcagtcttgacatcgacgtcggttgcactgatctgaatgaggatcttggtgtctgggtcatcttcaagattaagactcaagatggtcatgctagactcggcaacttggagttcctggaggagaagccattggtcggtgaggctttggctagagtcaagcgcgctgagaagaaatggagagataagagggagaagctggagtgggagaccaacatcgtgtacaaggaggctaaagagtcagtcgatgctctgttcgtcaatagccagtacgatcagctccaagctgacacaaacatcgctatgattcatgctgccgataagagggtccatagtatccgtgaggcttatctgcctgagttgtcagtcatacctggtgtgaatgctgccatcttcgaggagctggagggtcgcatcttcacagcgttcagtctgtacgatgcacgtaacgtcatcaagaacggtgacttcaacaacggtctgtcctgctggaatgtgaaaggccacgtggatgtggaggaacagaacaaccagcgttcagtgctcgtcgtacctgagtgggaggcagaggtgtcacaggaggtgcgtgtgtgccctggacgtggctacatcctccgtgttacagcatacaaggagggatacggcgagggatgtgtgaccatccacgagatcgagaacaacacagatgaactaaagttcagcaattgtgttgaggaggaaatctacccgaacaacacagtgacatgcaacgactacacagtgaaccaggaagaatacggaggagcatacacatcacgtaaccgaggatacaacgaggcaccttcagttccggccgactacgcctcagtttacgaggagaagtcatacacagatggacgaagggagaacccttgtgagttcaatcgaggctaccgagactacacacctttgcctgtgggctacgtgacaaaggagctggaatacttccctgaaacagacaaagtatggatcgagatcggagaaacagaaggaacattcatcgtggactccgtggagctgctgctgatggaggagtga

SEQ ID NO: 118 - DNA, 3573 bp, Artificial
  Synthetic DNA sequence for expression in plants encoding TIC845.
atgaccagcaaccggaagaacgagaacgagatcatcaacgccctgagcatcccgaccgtgagcaaccctagcacccagatgaacctgagccctgacgctcgcatcgaggactccctctgcgtggctgaggtgaacaacatcgacccgttcgtgtccgcctccaccgtgcagaccggcatcaacatcgcgggccgcatcctcggcgtgctcggcgtgccctttgcgggccagctcgcctccttctactccttcctcgtgggagagctgtggccctccggccgcgacccgtgggagatcttcctggagcacgtggagcagctcatccgccagcaagtcaccgagaacacccgcaacaccgccatcgcccgcctggagggcctgggccgtggctaccgctcctaccagcaagccctggagacctggctcgacaaccgcaacgacgcccgctcccgctccatcatcctggagcgctacgtcgccctggaactggacatcaccactgccatcccactcttccgcatcaggaacgaggaggtgcctctgctgatggtgtacgcccaggctgcgaacctgcacctgctgctgctgcgcgacgcaagcctgtttggctccgagtggggtatggcaagctccgacgtcaaccagtactaccaggagcagatccgctacaccgaggagtacagcaaccactgcgtccagtggtacaacaccggtctgaacaatctcagagggaccaacgctgagagctggctgcgctacaaccagttccggcgggatctgaccctaggtgtcctggatctggtcgctctgttcccgagctacgataccaggacgtaccctatcaacacctctgctcagcttaccagggagatctacactgatcctatcggtaggactaacgctcctagtggtttcgccagcactaactggttcaacaacaacgcgcctagtttctctgccatcgaggcggcgatcttccggcctcctcacctcctcgacttcccggagcagcttactatctactctgcgtcttcgcggtggtcttcgactcagcacatgaactactgggttggtcaccggcttaacttccgcccgattggaggaactcttaacaccagtacgcaaggtcttacgaacaacacttccatcaacccggttacgttgcagttcacgtctcgggacgtttaccggacggagtcgaatgctgggacgaacatcctgttcacgacaccggtgaatggtgttccgtgggcacgtttcaacttcatcaacccgcagaacatctacgagcgtggagcaacgacatactcgcaaccataccaaggcgttggcatccaactgtttgactcggagacggaactgccaccagagacgacagaacgtccgaattacgagtcatactcacacagactatcacacattggactcattatcggaaacacactgagagcaccagtgtactcatggacacatcggtcagcagatcgtacgaacatcatcgcctccgactccatcacccagattccggctgtgaagggcaacttcctgttcaacggcagcgtcatctccggccctgggttcaccggcggcgatctcgtcagactcaactcctccggcaacaacatccagaatcgtggctacattgaggttcccatccacttcccatccacctccacccgctatcgcgtgcgcgtgcgctacgcatccgtgactccgatccatctcaacgtcaactggggcaactcctccatcttctccaacaccgtgcccgccaccgcgacctcccttgacaacctccagagcagcgacttcggctacttcgagtctgccaatgccttcacctcctccttgggcaacatcgtaggtgtgaggaacttctccggcactgcgggcgtcatcatcgaccgcttcgagttcatccctgtgaccgccactctggaagccgagtacaacctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 119 - DNA, 3567 bp, Artificial
  Synthetic DNA sequence for expression in plants encoding TIC846.
atgaccagcaaccggaagaacgagaacgagatcatcaacgccctgagcatcccgaccgtgagcaaccctagcacccagatgaacctgagccctgacgctcgcatcgaggactccctctgcgtggctgaggtgaacaacatcgacccgttcgtgtccgcctccaccgtgcagaccggcatcaacatcgcgggccgcatcctcggcgtgctcggcgtgccctttgcgggccagctcgcctccttctactccttcctcgtgggagagctgtggccctccggccgcgacccgtgggagatcttcctggagcacgtggagcagctcatccgccagcaagtcaccgagaacacccgcaacaccgccatcgcccgcctggagggcctgggccgtggctaccgctcctaccagcaagccctggagacctggctcgacaaccgcaacgacgcccgctcccgctccatcatcctggagcgctacgtcgccctggaactggacatcaccactgccatcccactcttccgcatcaggaacgaggaggtgcctctgctgatggtgtacgcccaggctgcgaacctgcacctgctgctgctgcgcgacgcaagcctgtttggctccgagtggggtatggcaagctccgacgtcaaccagtactaccaggagcagatccgctacaccgaggagtacagcaaccactgcgtccagtggtacaacaccggtctgaacaatctcagagggaccaacgctgagagctggctgcgctacaaccagttccggcgggatctgaccctaggtgtcctggatctggtcgctctgttcccgagctacgataccaggacgtaccctatcaacacctctgctcagcttaccagggagatctacactgatcctatcggtaggactaacgctcctagtggtttcgccagcactaactggttcaacaacaacgcgcctagtttctctgccatcgaggcggcgatcttccggcctcctcacctcctcgacttcccggagcagcttactatctactctgcgtcttcgcggtggtcttcgactcagcacatgaactactgggttggtcaccggcttaacttccgcccgattggaggaactcttaacaccagtacgcaaggtcttacgaacaacacttccatcaacccggttacgttgcagttcacgtctcgggacgtttaccggacggagtcgaatgctgggacgaacatcctgttcacgacaccggtgaatggtgttccgtgggcacgtttcaacttcatcaacccgcagaacatctacgagcgtggagcaacgacatactcgcaaccataccaaggcgttggcatccaactgtttgactcggagacggaactgccaccagagacgacagaacgtccgaattacgagtcatactcacacagactatcacacattggactcattatcggaaacacactgagagcaccagtgtactcatggacacatcggtcagcagatcgtacgaacaccatcggtcccaaccgcatcactcagatcccgctcgtgaaggcactgaacctgcacagcggagtgaccgtggtgggcggccctggcttcaccggcggcgacattcttcgccgcacgaacacaggcaccttcgctgacatgcgtgtgaacatcaccggcccactcagccaacgctaccgcgttcgcatccgctacgccagcaccaccgatctccagttcttcacccgcatcaatggcacgtctgtgaaccagggcaacttccagcgcaccatgaaccgtggcgacaacctcgaatctggcaacttccgcactgcgggcttctcgacgcccttctccttctccaacgcgcagtccaccttcaccttgggcactcaggcgttctccaaccaggaggtgtacatcgacaggatcgagttcgtaccagccgaagtgaccttcgaggccgagtccgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 120 - DNA, 3570 bp, Artificial
  Synthetic DNA sequence for expression in plants encoding TIC858.
atgaccagcaaccggaagaacgagaacgagatcatcaacgccctgagcatcccgaccgtgagcaaccctagcacccagatgaacctgagccctgacgctcgcatcgaggactccctctgcgtggctgaggtgaacaacatcgacccgttcgtgtccgcctccaccgtgcagaccggcatcaacatcgcgggccgcatcctcggcgtgctcggcgtgccctttgcgggccagctcgcctccttctactccttcctcgtgggagagctgtggccctccggccgcgacccgtgggagatcttcctggagcacgtggagcagctcatccgccagcaagtcaccgagaacacccgcaacaccgccatcgcccgcctggagggcctgggccgtggctaccgctcctaccagcaagccctggagacctggctcgacaaccgcaacgacgcccgctcccgctccatcatcctggagcgctacgtcgccctggaactggacatcaccactgccatcccactcttccgcatcaggaacgaggaggtgcctctgctgatggtgtacgcccaggctgcgaacctgcacctgctgctgctgcgcgacgcaagcctgtttggctccgagtggggtatggcaagctccgacgtcaaccagtactaccaggagcagatccgctacaccgaggagtacagcaaccactgcgtccagtggtacaacaccggtctgaacaatctcagagggaccaacgctgagagctggctgcgctacaaccagttccggcgggatctgaccctaggtgtcctggatctggtcgctctgttcccgagctacgataccaggacgtaccctatcaacacctctgctcagcttaccagggagatctacactgatcctatcggtaggactaacgctcctagtggtttcgccagcactaactggttcaacaacaacgcgcctagtttctctgccatcgaggcggcgatcttccggcctcctcacctcctcgacttcccggagcagcttactatctactctgcgtcttcgcggtggtcttcgactcagcacatgaactactgggttggtcaccggcttaacttccgcccgattggaggaactcttaacaccagtacgcaaggtcttacgaacaacacttccatcaacccggttacgttgcagttcacgtctcgggacgtttaccggacggagtcgaatgctgggacgaacatcctgttcacgacaccggtgaatggtgttccgtgggcacgtttcaacttcatcaacccgcagaacatctacgagcgtggagcaacgacatactcgcaaccataccaaggcgttggcatccaactgtttgactcggagacggaactgccaccagagacgacagaacgtccgaattacgagtcatactcacacagactatcacacattggactcattatcggaaacacactgagagcaccagtgtactcatggacacatcggtcagcagatcgtacgaacaccatcggtccgaaccgcatcactcagatccctatggtcaaggcttccgaacttcctcaaggaaccaccgtggtgcgtggcccaggcttcacaggcggcgacattctccgccgcacgaacactggcggcttcggcccgattcgtgtgacagtcaatggtccgctgacccaacgctatcgcataggctttcgctacgcctccaccgttgacttcgacttcttcgtgtcgcgtggtggtacgaccgtcaacaacttccgcttccttcgcaccatgaactcaggagacgagttgaagtacggcaacttcgtacgccgcgccttcaccacgccgttcaccttcacccagatccaggacatcatcaggaccagcatccaaggtctctctggcaatggcgaagtgtacatcgacaagatcgagatcatcccagtgactgcgacctttgaagcagagtacgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 121 - DNA, 3564 bp, Artificial
  Synthetic DNA sequence for expression in plants encoding TIC866.
atgacgtccaaccggaagaacgagaacgagatcatcaacgcgctgtcaatcccggcggtgtccaaccactcggcccagatgaacctgtccacggacgccaggatcgaggacagcctctgcatcgccgagggcaacaacattgacccgttcgttagcgccagcaccgtccagaccggcattaacatcgcgggccgcatcctcggcgttctgggcgtcccgttcgcgggccagatcgcctcattctacagcttcctggtgggagagctgtggccgcgtgggcgcgacccgtgggagatcttcctggagcacgtggagcagctcatcaggcagcaagtcaccgagaacacacgagacaccgcattggcgcggctccagggcctgggcaactcattccgcgcgtaccagcagagcctggaggactggctggagaaccgagacgacgcgcgcactcgctccgtcctgtacacgcagtacatcgcccttgagctggacttcctcaacgcgatgccactgttcgccatccggaaccaggaggtgccgctcctcatggtgtacgctcaggctgccaacctccacctgctgctgctgcgggacgcatccctgttcgggtcggagttcggcctgacctcccaggagattcagcgctactacgagcggcaagtggagaagacaagggagtacagtgattattgcgcccgctggtacaacaccgggttgaacaacttgcgaggcaccaacgcggagtcatggctccgctacaatcagttccggcgagacctcacgctgggcgtgctcgacctcgtggccctcttcccttcgtacgacacgcgcgtgtacccaatgaacaccagcgcccagctcacgcgcgaaatctacacggaccctatcggtcgtacaaatgcaccgtcgggcttcgcctcgacaaactggtttaacaataacgcgccttctttctcagcaatcgaggccgctgtgattcggcctccgcatctgctcgatttcccggagcagcttactatcttctctgttctcagccgctggagcaacacacagtacatgaactattgggtcgggcaccgtctggagagccgcactattcgaggctcactgtcaaccagcacacacgggaacaccaacaccagcatcaacccggtcaccctgcaattcacttcccgcgatgtgtacaggacggagagtttcgcgggcattaacattctgctcactactccggtcaacggtgtcccgtgggcccgcttcaactggaggaatccgctgaacagcctgcgtggctcccttctctacacaatcggttacacgggtgtcggcacccagctcttcgactctgaaaccgagctgccacctgaaactacagagcgacctaactacgagtcctacagtcaccgtctgagcaacatccgcctaatcagcgggaacactcttcgagcgccggtgtactcctggacccacagatcagcagaccggaccaacactatctcgtccgactccatcacccagatccctctcgtgaaggctcacacccttcagagcgggacgaccgtggtgcgcgggccgggcttcaccggtggcgacatcctgcgacgtacttccggcggtccattcgcatacacaatcgtgaacatcaacggacagctcccgcagcgttaccgggccaggataagatacgccagcacaacgaacctccggatctacgtgaccgtggctggcgaacggatctttgctggtcagttcaataagacaatggacacgggcgacccgctgacgttccaatcgttctcgtacgcgaccatcaatacggcattcacgtttccgatgtcccagtcctccttcacagtcggtgctgatacgttcagctccgggaacgaggtgtacatcgaccgctttgaactaattccggtcaccgcgacgttcgaggctgagtacgatttggagcgcgcgcagaaggcagtcaatgagctgttcacttccagcaaccagatcggcctcaagaccgatgtgaccgactaccacatcgaccaagtgtcgaacctggtggagtgcctgagtgacgagttctgcttggacgagaagaaggagctgtctgagaaggtcaaacatgctaagaggctgtcagacgagcgtaacctccttcaagatcctaacttccgtggcatcaaccgccaactggatcgcgggtggcgaggcagtacagacatcaccatccagggaggcgatgacgtcttcaaggagaactacgttacgctgctgggcacgttcgacgaatgctacccgacttacctgtaccagaagatcgacgagagcaagttgaaggcttacacccgttaccagctcagaggttacattgaggactcccaggatctggaaatctacctgatccgctacaacgctaagcacgagaccgtgaatgtgcccggcactggttccctgtggccgctgtcggctccgtcgcccatcggcaagtgcgcccaccactcccaccacttcagtctggacattgacgtcggctgcaccgacctaaatgaggacttgggtgtctgggttatcttcaagatcaagacccaggacgggcacgctcgtcttggcaacttggagtttctggaggagaagccgctggtcggcgaggccctggcccgagtaaagcgggccgagaagaagtggcgcgataagcgggagaagctggagtgggagaccaacatcgtgtacaaggaggcaaaggagagcgtggacgccctcttcgttaattcgcagtacgaccggttgcaagctgacacaaacatcgctatgatccacgccgccgacaagagggtccactccatcagggaggcttacctgccggaattgtcggtgatccctggcgtgaatgctgccatctttgaggagctggagggacggatcttcacagcgttctccctgtacgatgctaggaacgtcatcaagaacggcgacttcaacaacggtctgagctgctggaacgtgaagggccatgtggacgtggaggagcagaacaaccaccgcagcgtgctggtcgtgcccgagtgggaagcggaggtcagccaggaggtgcgtgtctgccctggacgcggctacatcctgcgggtgaccgcgtacaaggagggctacggcgaaggatgcgttaccatccacgagattgagaacaatacggacgagcttaagtttagcaactgcgtggaggaggaggtgtacccgaataacacggtgacctgcaacgactacacggccacccaagaggaatacgaaggcacctacaccagccgcaaccgtggctacgacggtgcctacgagagcaacagctccgtgcccgctgactacgcttcggcctacgaggagaaggcgtacactgacggcagacgcgacaacccttgcgagagcaacagaggctacggtgactacacgccgctcccggctggctacgtcaccaaggaactggagtacttcccggagaccgacaaggtgtggatagagataggcgagaccgagggcactttcatcgtcgatagcgtcgagcttcttctgatggaggagtga

SEQ ID NO: 122 - DNA, 3525 bp, Artificial
  Synthetic DNA sequence for expression in plants encoding TIC838.
atggaggagaacaaccagaaccagtgcatcccgtacaactgcctgagcaaccctgaggaggtgctcctagacggtgagcgcatctccaccggcaactctagcatcgacatctccctgagcctagtgcagttcctagtgagcaacttcgtgcccggcggtggcttcctcgtgggcctcatcgacttcgtgtggggcatcgtgggcccgtcccagtgggacgccttcctcgtgcagatcgagcagctcatcaacgagcgcatcgccgagttcgcccgcaacgccgctatcgccaacctggagggcctcggcaacaatttcaacatctacgtggaggcgttcaaggagtgggaggaagacccgaacaatcccgccacccgcacccgcgtgatcgaccgcttccgcatcctcgacggcctcctggagcgcgacatcccgtccttcgccatctccggcttcgaggtgccgctcctgtccgtgtacgcccaggccgctaacctccacctcgccatcctccgcgactccgtgatcttcggcgagcgctggggcctcaccactatcaacgtgaacgagaactacaaccgcctcatccgccacatcgacgagtacgctgaccactgcgccaacacctacaacaggggcctcaacaatctgcccaagtccacctaccaggactggatcacctacaacaggctgaggcgcgacctgaccctgaccgtgctggacatcgctgcgttcttcccgaactacgacaacaggcgctaccccatccagagcgtcggccagctcaccagggagatctacaccgatccgctcatcaccttcaaccctcagctccagtccgtcgctcagctccctaccttcaacgtcatggagtccaacgctatccgcacccctcacctgttcgatgtcctgaacaatcttaccatcttcaccgattggttctccgtcggcaggaacttctactggggcggtcacagggtcattagcaacaggatcggcggtggcaacattaccagccctatctacggcagggaggctaaccaggagcctccgaggagcttcactttcaacggtcctgtcttccggactcttagcaaccctactttccggcctcttcagcaaccttggcccgcgccgccattcaaccttcggggtgtcgagggtgtcgagttcagcactccgcttaacagcttcacttaccggggtagaggcactgtcgatagccttactgaacttccgccagaagataacagcgtcccgccacgtgaagggtacagccaccgtctttgtcacgcgactttcgtccagcgtagtgggactccgttccttacgacagggccggtctttagttggacgcatcgctctgcgacggacagaaacattatcgcgtctgacagtattacgcaaattccggcggttaagggcaacttcctcttcaatgggtctgttatttctgggccagggtttacgggcggagatttggttcgtttgaacagcagcgggaacaacatccagaacagaggctacattgaagtgccaatccacttcccatctacgagcacgcgctatcgcgttagagttcgatacgcatcggttacaccaatccacctgaatgttaattggggaaattcatcaatcttctcgaacacagttccagcaacagcaacatcattagacaatttgcaatcatcagatttcggatacttcgaatcggcaaacgcattcacatcgtcgttgggcaacatcgtaggagtacgcaacttctcgggcaccgccggcgtgatcattgaccgcttcgagtttatcccggtcactgctacgctggaggcggaatacaaccttgagagagcgcagaaggccgtgaacgcgctgttcacctcgactaaccagttgggactcaagacaaatgtcactgactaccacatcgaccaagtgagtaatctcgttacctacctgtcggacgagttctgcctggatgagaagagggaactgtctgagaaagtgaagcacgcaaagcgcctctcggatgagaggaacctcctccaggattccaacttcaaggacatcaaccggcagccggaaagaggctggggtggctccaccggcattactatccagggcggcgacgatgtgttcaaggagaactacgtcacactctcaggcactttcgacgagtgttacccgacgtacctgtaccagaagattgatgagtccaagctgaaggcattcacccgctatcagcttcgcggttacattgaagattcccaggaccttgagatctacctcatcaggtacaacgccaagcacgagacggtcaacgtgcccggcacgggttccctgtggccgttgtctgcccaatctcccatcgggaagtgcggtgagccgaaccgttgcgccccgcacctggagtggaaccctgacctggattgctcctgtagggatggcgagaagtgcgctcaccattcccaccacttctcgctggacatcgacgtggggtgcacggatctcaacgaggatctcggagtctgggtcatcttcaagatcaagacgcaggacggacacgctcgcctcggcaatctggagtttcttgaggaaaagccgctcgtaggtgaggcgctcgccagggtaaagcgcgcggagaagaagtggagggataagcgtgagaaacttgaatgggagacaaacatcgtctacaaggaagcaaaggagtcagttgatgcactgttcgtcaactctcagtatgaccagttgcaggccgataccaacatcgcgatgatccacgccgctgacaagcgcgttcactcgatccgcgaggcgtacctccctgagctttccgtcatcccaggcgtcaatgcggccatcttcgaggaacttgagggccggatcttcaccgctttctcgctctacgacgctagaaacgtcatcaagaacggcgacttcaacaatggcctgagctgctggaatgtgaagggtcatgtggatgtcgaagagcagaacaatcagcgttctgtgctcgtggtccccgaatgggaagctgaggtttcccaagaagtgagagtgtgcccaggacgcggttacattctccgtgttacggcgtacaaggagggctatggcgaaggctgcgtgaccattcatgagatcgagaacaacacggatgagctgaagttctcaaactgcgtcgaggaagaaatctaccctaacaacactgtgacctgtaacgactacacggtgaaccaggaagagtacggcggcgcttacactagccgcaaccgtgggtacaacgaggccccatcggtccctgctgactacgcatccgtctacgaggagaagtcttacactgacgggagacgggagaacccctgcgagttcaaccggggttacagggattacacgcctctgcccgttggctatgtcactaaggagctggagtatttcccggagactgataaagtctggatcgagatcggggagactgaagggactttcatcgtcgattccgtggagctgcttctgatggaggagtga

SEQ ID NO: 123 - DNA, 3519 bp, Artificial
  Synthetic DNA sequence for expression in plants encoding TIC841.
atggaggagaacaaccagaaccagtgcatcccgtacaactgcctgagcaaccctgaggaggtgctcctagacggtgagcgcatctccaccggcaactctagcatcgacatctccctgagcctagtgcagttcctagtgagcaacttcgtgcccggcggtggcttcctcgtgggcctcatcgacttcgtgtggggcatcgtgggcccgtcccagtgggacgccttcctcgtgcagatcgagcagctcatcaacgagcgcatcgccgagttcgcccgcaacgccgctatcgccaacctggagggcctcggcaacaatttcaacatctacgtggaggcgttcaaggagtgggaggaagacccgaacaatcccgccacccgcacccgcgtgatcgaccgcttccgcatcctcgacggcctcctggagcgcgacatcccgtccttcgccatctccggcttcgaggtgccgctcctgtccgtgtacgcccaggccgctaacctccacctcgccatcctccgcgactccgtgatcttcggcgagcgctggggcctcaccactatcaacgtgaacgagaactacaaccgcctcatccgccacatcgacgagtacgctgaccactgcgccaacacctacaacaggggcctcaacaatctgcccaagtccacctaccaggactggatcacctacaacaggctgaggcgcgacctgaccctgaccgtgctggacatcgctgcgttcttcccgaactacgacaacaggcgctaccccatccagagcgtcggccagctcaccagggagatctacaccgatccgctcatcaccttcaaccctcagctccagtccgtcgctcagctccctaccttcaacgtcatggagtccaacgctatccgcacccctcacctgttcgatgtcctgaacaatcttaccatcttcaccgattggttctccgtcggcaggaacttctactggggcggtcacagggtcattagcaacaggatcggcggtggcaacattaccagccctatctacggcagggaggctaaccaggagcctccgaggagcttcactttcaacggtcctgtcttccggactcttagcaaccctactttccggcctcttcagcaaccttggcccgcgccgccattcaaccttcggggtgtcgagggtgtcgagttcagcactccgcttaacagcttcacttaccggggtagaggcactgtcgatagccttactgaacttccgccagaagataacagcgtcccgccacgtgaagggtacagccaccgtctttgtcacgcgactttcgtccagcgtagtgggactccgttccttacgacagggccggtctttagttggacgcatcgctctgcgacggacagaaacaccatcgacccggagcgcatcaaccagatccctctcgtgaagggcttccgcgtgtggggcggcacctccgtcatcaccggccctggcttcaccggcggcgacattcttcgccgcacgaacacaggcaccttcgctgacatgcgtgtgaacatcaccggcccactcagccaacgctaccgcgttcgcatccgctacgccagcaccaccgatctccagttcttcacccgcatcaatggcacgtctgtgaaccagggcaacttccagcgcaccatgaaccgtggcgacaacctcgaatctggcaacttccgcactgcgggcttctcgacgcccttctccttctccaacgcgcagtccaccttcaccttgggcactcaggcgttctccaaccaggaggtgtacatcgacaggatcgagttcgtaccagccgaagtgaccttcgaggccgagtccgatctcgagcgcgcccagaaggccgtgaacgccctcttcactagcactaaccagctcggcctcaagactaacgtgaccgactaccacattgaccaagtgagcaacctagtgacctaccttagcgacgagttctgccttgacgagaagcgtgagctgagcgagaaggtgaagcacgccaagcgcctctccgacgagcgcaacctcctccaggactccaacttcaaggacatcaaccgccagcccgagcgcggctggggcggtagcaccggcatcaccatccagggcggtgacgatgtgttcaaggagaactacgtgaccctctccggcaccttcgacgagtgctacccgacctacctctaccagaagatcgacgagtccaagctcaaggcgttcacccgctaccagcttcgcggctacatcgaggactcccaggatctggagatctacctcatccgctacaacgccaagcacgagaccgtgaacgtgcccggcaccggctccctctggccgctctccgcccagagccctatcggcaagtgcggcgagcccaaccgctgcgcgcctcacctggagtggaaccctgacctcgactgctcctgccgcgacggcgagaagtgcgcccaccatagccaccacttctctctcgacatcgacgtgggctgcaccgacctcaacgaggatctgggcgtgtgggtgatcttcaagatcaagacccaggacggccacgccaggctgggcaacctggagttcctggaggagaagcctctggtgggtgaggccctggccagggtcaagagggctgagaagaaatggagggacaagagggagaagctggagtgggagaccaacatcgtgtacaaggaggctaaggagtccgtggacgctctgttcgtcaactctcagtacgatcagctccaggctgacaccaacatcgctatgatccacgctgcggataagagggtccactctatcagggaggcttacctgcctgagctttctgtcatccctggtgtcaacgcggcaatcttcgaggaacttgagggccgcatcttcactgcgttctcgctttacgatgcgcggaacgtcattaagaacggtgacttcaacaatggtctttcgtgctggaacgtcaagggtcatgtcgatgtcgaggaacagaacaaccagcggtcggtccttgtcgttcccgagtgggaggccgaggtctcgcaagaggtccgggtctgccctgggcgcgggtacattcttcgtgtcactgcgtacaaggagggctacggcgagggctgcgttactattcatgagattgagaacaatacggatgagcttaagtttagtaactgtgttgaggaggagatctacccgaacaatacggttacgtgcaatgattacacggtgaaccaggaggaatacggcggagcatacacctcacgtaatagagggtacaatgaggcaccgtcagttccggcagattatgcctcagtttatgaggagaagtcctacacggatggaagacgcgagaatccatgtgagtttaatagaggataccgagactacacaccactcccagttggatacgttacaaaggagttggaatacttcccagaaacagataaagtttggatagagatcggagaaacagaaggaaccttcatcgtggacagtgtagaactgctgctgatggaagaatga

SEQ ID NO: 124 - DNA, 3516 bp, Artificial
  Synthetic DNA sequence for expression in plants encoding TIC842.
atggctgagaacaacatccagaaccagtgcgtgccctacaactgcctgaacaaccctgaggtggagatcctgaacgaggagcgtagcaccggtaggctcccgctagacatctccctgagcctgacccgcttcctccttagcgagttcgtgcccggcgtgggcgtggccttcggcctcttcgacctcatctggggcttcatcacgccgtccgactggtccctcttcctcctccagatcgagcagctcatcgagcagcgcatcgagaccctggagcgcaaccgcgccatcaccactctgcgcggcctcgccgactcctacgaaatctacatcgaggccctccgcgagtgggaggccaacccgaacaatgcccagctccgcgaggacgtgcggattcgcttcgccaacaccgacgatgccctcatcaccgccatcaacaacttcaccctcacctccttcgagatcccgctgctcagcgtgtacgtgcaagccgctaacctccacctctccctcctgcgcgacgccgtgagcttcggccagggctggggcctcgacatcgccaccgtgaacaatcactacaaccgcctcatcaacctcatccaccgctacaccaagcactgcctcgacacctacaaccagggcctggagaacctgcgcggcaccaacacccgccagtgggcccgcttcaaccagttccgccgcgacctcaccctcaccgtgctcgacatcgtggccctgttccctaactacgacgtccgcacctacccgatccagacctccagccagctcacgagggaaatctacacctccagcgtgatcgaggacagcccggtgtccgccaacatcccgaacggcttcaaccgcgccgagttcggcgtgcgcccgcctcacctcatggacttcatgaactccctcttcgtcactgccgagaccgtgcgctcccagaccgtgtggggcggtcacctcgtgtccagccgcaacaccgctggcaaccgcatcaacttcccgtcctacggcgtgttcaaccctggcggtgccatctggatcgccgacgaggacccgaggcccttctaccgcaccctgtccgaccctgtgttcgtgcgcggcggtttcggcaaccctcactacgtgctgggcctgaggggcgtggccttccagcaaaccggcaccaaccacacccgcaccttccgcaactccggcaccatcgactccctggacgagatccctcctcaggacaactccggcgccccttggaacgactactcccacgtgctgaaccacgtgaccttcgtgaggtggcctggcgagatcagcggcagcgactcctggagggcccctatgttctcctggacccacaggagcgccaccccgaccaacaccatcgaccctgagcgcatcacccagatccctctggtgaaggcccacactctccagagcggcactactgtcgttcgcggccctggcttcactggcggtgacatcctgaggcggactagcggcggtcctttcgcttacactatcgtcaacatcaacggccagctccctcagcgctacagggcccgcatccgctacgccagcactactaacctgaggatctacgtcactgtcgctggcgagcgcatcttcgccgggcagttcaacaagacgatggacactggtgacccgctgactttccagtctttctcttacgctactatcaacactgctttcactttcccgatgagtcagtcttcgttcactgtcggtgctgacactttctcttcgggcaacgaggtgtacatcgaccggttcgagctgatcccggtcactgctactttcgaggctgagtacgacctggagcgggctcagaaggctgtcaacgctctgttcacttctatcaaccagatcggtattaagacggacgtcacggactaccacattgaccaagtcagcaacctggtggactgcctgtctgacgagttctgcctggacgagaagcgggagctgtctgagaaggtcaagcacgctaagcggctgtctgacgagcggaacctgctccaagacccgaactttaagggtattaaccgccagctcgaccgtggttggcgcggtagtacggacattacgattcagcgcggtgacgatgtcttcaaggagaactacgtcacgctgccgggtaccttcgacgagtgctacccgacgtacctttaccagaagattgatgagtctaagctcaaggcgtttacgcgctaccagcttcgtggttacattgaggatagtcaggatcttgaaatctaccttattcgttacaacgctaagcacgagacggtcaacgtgccgggtacgggctctctttggccgctttctgctcagtctccgattgggaagtgcggtgagccgaaccgttgcgcgccgcaccttgagtggaacccggatcttgattgctcgtgccgtgatggcgagaagtgcgcgcaccatagtcatcacttcagtcttgacattgatgtcgggtgcacggatcttaacgaggatcttggcgtgtgggtgatcttcaagattaagacgcaagatgggcacgcgcgtcttgggaaccttgagtttcttgaggagaagccacttgtcggcgaggcgcttgcgcgtgtcaagcgtgcggagaagaaatggcgtgataagcgtgagaagttggagtgggagacgaacattgtgtacaaggaggcgaaggagtcggtcgatgcgttgttcgtcaacagtcagtacgatcagttgcaagcggatacgaacatcgccatgattcatgcggcagataagcgtgtccattcgatcagggaggcgtacctgccagagttgtcggtcattccaggcgtcaatgcggcaatcttcgaggaattggagggcagaatcttcacggcattctcgctgtacgatgcaaggaatgtgattaagaatggcgatttcaacaacgggctgtcgtgctggaatgttaagggccatgttgatgttgaggaacagaacaaccagagatcagtgttggtcgtaccagagtgggaggcagaggtttcacaagaggtgagagtctgcccagggcgcggctacatcttgagagttaccgcctacaaggagggatacggcgagggatgtgtgacaattcacgaaatcgagaacaacacagacgagctaaagttctcaaactgtgtcgaggaagaaatctacccgaataacacagtcacatgcaatgattacacagtgaaccaggaagaatacggaggagcatacacatcacgcaatagaggatacaatgaagcaccaagcgttccagcagactacgcctcagtgtacgaggagaagtcatacacagacggacgaagggagaatccatgtgagttcaatcgaggataccgagattacacaccacttccagttggatacgttaccaaggaactcgaatacttcccagaaacagacaaagtgtggatcgaaatcggcgaaaccgaaggcacattcatcgtggactcagtcgaactgctgctgatggaggagtga

SEQ ID NO: 125 - DNA, 3444 bp, Artificial
  Synthetic DNA sequence for expression in plants encoding TIC850.
atggagaacaacatccagaaccagtgcgtgccctacaactgcctgaacaaccctgaggttgagatcctgaacgaggagcgtagcaccggtaggctcccgctagacatctccctgagcctgacccgcttcctccttagtgagttcgtgcccggcgtgggcgtggccttcggcctcttcgacctcatctggggcttcatcactccttccgactggtccctcttcctccttcagattgagcaactgatcgagcagcgcatcgagacccttgagcgcaaccgcgccatcaccactctcagaggtctcgccgactcctacgaaatctacatcgaggcactccgtgagtgggaggccaacccgaacaatgcccagctccgcgaggacgtgaggatcagattcgccaacaccgacgatgccctcatcaccgccatcaacaatttcaccctcacctccttcgagatccctcttctgtctgtgtacgttcaagctgctaaccttcacctttccctcctgcgcgacgccgtgagcttcggccagggctggggcctcgacatcgccaccgtgaacaatcactacaaccgcctcatcaacctcatccaccgctacaccaagcactgccttgacacctacaaccagggccttgagaacctccgtggcaccaacacccgccagtgggcccgcttcaaccagttccgcagagacctcaccctcaccgtgctcgacatcgtggcactcttcccaaactacgacgtgcgtacctaccctatccagacctccagccagctcaccagggaaatctacacctccagcgtgatcgaggactctcctgtgtccgccaacatccctaacggcttcaaccgcgccgagttcggcgtgcgccctcctcacctcatggacttcatgaactccctcttcgtcactgccgagaccgtgcgctcccagaccgtgtggggcggtcacctcgtgtccagccgtaacaccgctggcaacaggatcaacttcccgtcctacggcgtgttcaacccaggcggtgccatctggatcgccgatgaagaccctcgtcctttctaccgtaccctgtccgaccctgtgttcgtgcgtggcggtttcggcaaccctcactacgtgctgggcctgcgtggcgtggccttccagcaaaccggcaccaaccacaccaggacgttccgtaactccggcaccatcgacagtcttgacgagatccctccgcaagacaactccggtgcaccttggaacgactactcccacgtgctgaaccacgtgaccttcgtgaggtggcctggcgaaatctccggctccgactcctggagggctcctatgttcagttggacccacaggagcgctacgcctaccaacaccatcgatcctgaacgcatcactcagatccctctcgtcaaggctcacaccctccagtcaggcaccaccgtggtgcgcggccctggcttcaccggcggcgacatccttcgccgcacgaacaccggcacctttgcagacatgagggtcaacatcaccggtcctctctcccaacgctatcgcgtccgcattcgctatgcctcgaccaccgatctacagttcttcacccggatcaatggcacgtctgtgaaccagggcaacttccaacgcacgatgaaccgtggtgacaacctggagtccgggaacttccgaactgctggcttctccacgcccttcagcttctccaatgcccagtccaccttcactcttggcacccaagcgttcagcaaccaggaagtgtacatcgaccgcattgagtttgttcccgctgaggtgaccttcgaggccgagtctgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 126 - DNA, 3447 bp, Artificial
  Synthetic DNA sequence for expression in plants encoding TIC859.
atggagaacaacatccagaaccagtgcgtgccctacaactgcctgaacaaccctgaggttgagatcctgaacgaggagcgtagcaccggtaggctcccgctagacatctccctgagcctgacccgcttcctccttagtgagttcgtgcccggcgtgggcgtggccttcggcctcttcgacctcatctggggcttcatcactccttccgactggtccctcttcctccttcagattgagcaactgatcgagcagcgcatcgagacccttgagcgcaaccgcgccatcaccactctcagaggtctcgccgactcctacgaaatctacatcgaggcactccgtgagtgggaggccaacccgaacaatgcccagctccgcgaggacgtgaggatcagattcgccaacaccgacgatgccctcatcaccgccatcaacaatttcaccctcacctccttcgagatccctcttctgtctgtgtacgttcaagctgctaaccttcacctttccctcctgcgcgacgccgtgagcttcggccagggctggggcctcgacatcgccaccgtgaacaatcactacaaccgcctcatcaacctcatccaccgctacaccaagcactgccttgacacctacaaccagggccttgagaacctccgtggcaccaacacccgccagtgggcccgcttcaaccagttccgcagagacctcaccctcaccgtgctcgacatcgtggcactcttcccaaactacgacgtgcgtacctaccctatccagacctccagccagctcaccagggaaatctacacctccagcgtgatcgaggactctcctgtgtccgccaacatccctaacggcttcaaccgcgccgagttcggcgtgcgccctcctcacctcatggacttcatgaactccctcttcgtcactgccgagaccgtgcgctcccagaccgtgtggggcggtcacctcgtgtccagccgtaacaccgctggcaacaggatcaacttcccgtcctacggcgtgttcaacccaggcggtgccatctggatcgccgatgaagaccctcgtcctttctaccgtaccctgtccgaccctgtgttcgtgcgtggcggtttcggcaaccctcactacgtgctgggcctgcgtggcgtggccttccagcaaaccggcaccaaccacaccaggacgttccgtaactccggcaccatcgacagtcttgacgagatccctccgcaagacaactccggtgcaccttggaacgactactcccacgtgctgaaccacgtgaccttcgtgaggtggcctggcgaaatctccggctccgactcctggagggctcctatgttcagttggacccacaggagcgctacgcctaccaacgaggtccgtgtgtcccgcatcacccagctccctatggtgaaggctcacacccttcacgctggtgccacagtagtcagaggtccgggcttcactggcggcgacattcttcgccgcaccacctccggctccttcggcgacatgaggatcaccaacttcagctcctcctccagtcgctatcgcgttcgtattcgctacgcctccaccaccgacctccagttcttcctgtccgttggcggcacgcctgtgaatgtggcagacttcccgaagaccatcgaccgtggcgagaacctggagtacggcagctttcgcactgctggcttcaccactccgttcagcttcgtctcctccaccaacaacttcacactaggcgtgcagtctgtctcctccggcaacgagatcttcgtggatcggatcgagttcgtaccagccgacgcgaccttcgaagccgagtacgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 127 - DNA, 3612 bp, Artificial
  Synthetic DNA sequence for expression in plants encoding TIC861.
atgaagctcaagaaccctgacaagcaccagtccttctctagcaacgcgaaggtggacaagatcagcactgactccctcaagaacgagactgacatcgagcttcagaacatcaaccacgaggactgcctcaagatcagcgagtacgagaacgtggaacccttcgtgagcgcctccaccatccagaccggcatctccattgccgggaagatcctcggcaccctcggcgtacccttcgcgggccaagtggcctccctctactccttcatcctcggcgaactgtggcccaaaggcaagaaccagtgggagatcttcatggagcacgtggaggagatcatcaaccagaagatcagcacctatgcccgcaacaaggccctcaccgacctcaagggcctcggcgacgccctcgccgtgtaccacgagtccctggagtcctgggtcggcaaccgcaagaacacccgcgcccgctccgtggtgaagtcccagtacatcgccctggagctgatgttcgtgcagaagctcccgtccttcgccgtgagcggcgaggaggtgccgctcctgcccatctacgcccaggccgctaacctccacctcctgctcctgcgcgacgcctccatcttcggcaaggagtggggcctctccagctccgagatcagcaccttctacaaccgccaagtggaacgcgctggcgactactccgatcactgcgtgaagtggtacagcaccggcctcaacaacctgcgcggcaccaacgctgagagctgggtgcgctacaaccagttccgcaaggacatgaccctgatggtcctggatctggtcgcactgttcccgagctacgacactctggtgtacccgatcaagaccaccagccagctcaccagggaggtgtacaccgacgctatcggcactgtccatcctaatgcgagcttcgccagcaccacctggtacaacaacaacgctccttccttcagcaccatcgagagcgctgtggtgaggaatcctcacctgcttgacttcctggagcaagtcaccatctacagcctgctttctaggtggtccaacacccagtacatgaacatgtggggcggtcacaggctggagttccgcaccatcggcggtatgctgaacacctctactcagggaagtaccaacacttccatcaaccctgtcactctgcctttcacttctagggacgtttacaggactgagtccctggctggacttaacctgttccttactcagcctgtcaacggtgtcccgagggtggacttccactggaagttcgtcactcatcccatcgcgtctgacaacttctactaccctggttacgcgggtatcggtactcagctccaggacagtgagaatgagttgccgccggagacgaccggtcagccgaactacgagtcttacagtcacaggctttctcacatcggtctcatctctgcgtctcatgtcaaagcgcttgtgtactcgtggacgcatcgctcagcggatcgcacgaataccatcgacccagagcgcatcaaccagatcccgctcgtgaagggcttccgcgtgtggggcggcacctccgtcatcaccggtccgggcttcaccggcggcgacatcctccgccgcaacaccttcggcgacttcgtgtcactccaagtgaacatcaacagcccgatcacccagcgctatcgcctccgcttccgctacgcctcctcccgcgacgctagagtgatcgtgctcaccggagcggcgtccacaggcgtaggcggccaagtgtctgtgaacatgccgctccagaagactatggagattggtgagaacctcacctctcgcaccttccgctacaccgacttctccaatccgttctccttcagagccaacccagacatcatcggcatctccgagcagcctctctttggcgctggctccatctcctccggcgagctgtacatcgacaagattgagatcatccttgccgacgccaccttcgaagctgagtccgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 128 - DNA, 3432 bp, Artificial
  Synthetic DNA sequence for expression in plants encoding TIC848.
atggagatcaacaaccagaagcagtgcatcccgtacaactgcctgagcaaccctgaggaggtgctcctagacggtgagcgcatcctccctgacatcgacccgctggaggtgagcctgagcctcctccagttcctgctgaacaacttcgtgcccggcggtggcttcatctccgggctcgtggacaagatctggggcgcgctccgcccgtccgagtgggatctcttcctcgcccagatcgagcgcctcatcgaccagcgcatcgaggccaccgtgcgcgccaaggccatcaccgagctggagggcctgggccgcaactaccaaatctacgccgaggcgttcaaggagtgggagtccgacccggacaacgaggccgctaagtcccgcgtgatcgaccgcttccgcatcctcgacggcctcatcgaggccaacatcccgtccttccgcatcattggcttcgaggtgccgctgctgtccgtgtacgtgcaagccgctaacctccacctcgccctcctgcgcgactccgtgatcttcggcgagcgctggggcctcaccactaagaacgtgaacgacatctacaaccgccagatccgcgagatccacgaatactccaaccactgcgtggacacctacaacaccgagctggagcgcctcggcttccgctccatcgcccagtggcgcatctacaaccagttccgccgcgagctgaccctgaccgtcctggacatcgtggccctgttcccgaactacgacagccgcctctacccgatccagaccttctcccagctcacccgcgagatcgtgaccagcccggtgtccgagttctactatggcgtcatcaactccggcaacatcattggcaccctcaccgagcagcaaatccgccgcccgcacctgatggacttcttcaactccatgattatgtacacctccgacaaccgccgcgagcactactggtccggcctggagatgaccgcctacttcaccggcttcgcgggcgcgcaagtgtccttcccgctcgtgggcaccaggggcgagtccgcgccgcctctcaccgtgaggtccgtgaacgacggcatctaccgcatcctcagcgcgccgttctacagcgcgccgttcctgggcaccatcgtgctgggcagccgtggcgagaagttcgacttcgccctgaacaacatcagccctccgcctagcaccatctacaggcaccctggcaccgtggacagcctggtgagcatccctcctcaagacaacagcgtgcctccgcacaggggcagctctcacaggctgagccacgtgaccatgagggccagctctcctatcttccactggacccacaggagcgccaccactaccaacaccatcaaccctaacgctatcattcagatcccgctggtgaagtccaccaacctcggctccggcacctccgtggtgaagggtccgggcttcactggcggcgacatcctccgccgcaccagccctggccaaatctccaccctccgtgtgaacatcactgctccactgtcccaacgctatcgcgtacggattcgttacgcatccaccaccaacctccagttccacacctccattgacggccgaccgatcaaccagggcaacttctccgctacgatgtcctccgggtccaatctccagtctgggagctttcgcactgtcggcttcaccactccgttcaacttctccaatggctcctccgtgttcacactttcggcgcacgtcttcaactctggcaacgaagtgtacatcgacaggatcgagtttgttcccgcagaggtgaccttcgaagccgagtacgatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 129 - DNA, 3429 bp, Artificial
  Synthetic DNA sequence for expression in plants encoding TIC849.
atggagatcaacaaccagaagcagtgcatcccgtacaactgcctgagcaaccctgaggaggtgctcctagacggtgagcgcatcctccctgacatcgacccgctggaggtgagcctgagcctcctccagttcctgctgaacaacttcgtgcccggcggtggcttcatctccgggctcgtggacaagatctggggcgcgctccgcccgtccgagtgggatctcttcctcgcccagatcgagcgcctcatcgaccagcgcatcgaggccaccgtgcgcgccaaggccatcaccgagctggagggcctgggccgcaactaccaaatctacgccgaggcgttcaaggagtgggagtccgacccggacaacgaggccgctaagtcccgcgtgatcgaccgcttccgcatcctcgacggcctcatcgaggccaacatcccgtccttccgcatcattggcttcgaggtgccgctgctgtccgtgtacgtgcaagccgctaacctccacctcgccctcctgcgcgactccgtgatcttcggcgagcgctggggcctcaccactaagaacgtgaacgacatctacaaccgccagatccgcgagatccacgaatactccaaccactgcgtggacacctacaacaccgagctggagcgcctcggcttccgctccatcgcccagtggcgcatctacaaccagttccgccgcgagctgaccctgaccgtcctggacatcgtggccctgttcccgaactacgacagccgcctctacccgatccagaccttctcccagctcacccgcgagatcgtgaccagcccggtgtccgagttctactatggcgtcatcaactccggcaacatcattggcaccctcaccgagcagcaaatccgccgcccgcacctgatggacttcttcaactccatgattatgtacacctccgacaaccgccgcgagcactactggtccggcctggagatgaccgcctacttcaccggcttcgcgggcgcgcaagtgtccttcccgctcgtgggcaccaggggcgagtccgcgccgcctctcaccgtgaggtccgtgaacgacggcatctaccgcatcctcagcgcgccgttctacagcgcgccgttcctgggcaccatcgtgctgggcagccgtggcgagaagttcgacttcgccctgaacaacatcagccctccgcctagcaccatctacaggcaccctggcaccgtggacagcctggtgagcatccctcctcaagacaacagcgtgcctccgcacaggggcagctctcacaggctgagccacgtgaccatgagggccagctctcctatcttccactggacccacaggagcgccaccactaccaacaccatcaaccctaacgctatcattcagatcccgctggtgaaggcgttcaacctgcacagcggtgccaccgtggtgcgcggacctggcttcaccggcggcgacatccttcgccgcaccaacaccggcacctttggtgacattcgcctcaacatcaacgtgccactgtcccaacgctatcgcgttcgtattcgttacgcctccaccaccgatcttcagttcttcactcgcatcaatggcaccaccgtgaacattgggaacttctctcgaaccatgaaccgtggtgacaacctggagtaccgcagcttccggactgctggcttcagcacgccgttcaacttcctcaacgcccagtccaccttcactctaggtgcacagtccttctccaaccaggaagtgtacatcgaccgcgttgagtttgtgcccgctgaggtcacgttcgaagcggagtacgacctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

SEQ ID NO: 130 - DNA, 3570 bp, Artificial
  Synthetic DNA sequence for expression in plants encoding TIC847.
atgaccagcaaccggaagaacgagaacgagatcatcaacgccctgagcatcccgaccgtgagcaaccctagcacccagatgaacctgagccctgacgctcgcatcgaggactccctctgcgtggctgaggtgaacaacatcgacccgttcgtgtccgcctccaccgtgcagaccggcatcaacatcgcgggccgcatcctcggcgtgctcggcgtgccctttgcgggccagctcgcctccttctactccttcctcgtgggagagctgtggccctccggccgcgacccgtgggagatcttcctggagcacgtggagcagctcatccgccagcaagtcaccgagaacacccgcaacaccgccatcgcccgcctggagggcctgggccgtggctaccgctcctaccagcaagccctggagacctggctcgacaaccgcaacgacgcccgctcccgctccatcatcctggagcgctacgtcgccctggaactggacatcaccactgccatcccactcttccgcatcaggaacgaggaggtgcctctgctgatggtgtacgcccaggctgcgaacctgcacctgctgctgctgcgcgacgcaagcctgtttggctccgagtggggtatggcaagctccgacgtcaaccagtactaccaggagcagatccgctacaccgaggagtacagcaaccactgcgtccagtggtacaacaccggtctgaacaatctcagagggaccaacgctgagagctggctgcgctacaaccagttccggcgggatctgaccctaggtgtcctggatctggtcgctctgttcccgagctacgataccaggacgtaccctatcaacacctctgctcagcttaccagggagatctacactgatcctatcggtaggactaacgctcctagtggtttcgccagcactaactggttcaacaacaacgcgcctagtttctctgccatcgaggcggcgatcttccggcctcctcacctcctcgacttcccggagcagcttactatctactctgcgtcttcgcggtggtcttcgactcagcacatgaactactgggttggtcaccggcttaacttccgcccgattggaggaactcttaacaccagtacgcaaggtcttacgaacaacacttccatcaacccggttacgttgcagttcacgtctcgggacgtttaccggacggagtcgaatgctgggacgaacatcctgttcacgacaccggtgaatggtgttccgtgggcacgtttcaacttcatcaacccgcagaacatctacgagcgtggagcaacgacatactcgcaaccataccaaggcgttggcatccaactgtttgactcggagacggaactgccaccagagacgacagaacgtccgaattacgagtcatactcacacagactatcacacattggactcattatcggaaacacactgagagcaccagtgtactcatggacacatcggtcagcagatcgtacgaacaccatcggtcctaaccgtatcacccagattcctctcgtgaaggcccacaccctccagtccggcaccaccgtggtgaagggaccgggcttcaccggcggcgacatcctccgccgcacctctggcggcccgttcgcgttctccaacgtgaacctcgacttcaacctctcccaacgctacagagcacgcatacgctacgcctccaccaccaacctacgcatctacgtgaccgtggctggcgaacgcatcttcgctgggcagtttgacaagactatggacgctggcgcacctcttaccttccagtccttctcctacgccaccatcaacaccgcgttcaccttcccagagcgctcctcctccttgaccgtgggtgccgacaccttcagcagcggcaatgaggtgtacgtggatcgcttcgaactcatcccagtgaccgccaccttcgaggccgagtcggatctcgagcgtgcccagaaggcagtgaatgagctgttcacgagcagcaatcagatcgggctcaagaccgacgtgaccgactaccacatcgaccaagtcagcaatctggtggagtgtctcagcgacgagttctgcctggacgagaagaaggaactcagcgagaaggtgaagcacgccaaacgtctgtccgacgaacgcaatctgctgcaagatccgaacttcagagggatcaacaggcaactggaccgtgggtggcgtgggtccaccgacatcaccatccaaggcggcgacgacgtcttcaaggagaactacgtcactctgctgggcaccttcgacgagtgctatccgacctacctgtaccagaagatcgacgagagcaagctcaaggcgtacacccgctaccaactcagaggctacatcgaagactcccaggatctggaaatctacctcattcgctacaacgcgaagcacgagactgtcaacgtgcccggcactggcagcctgtggccgctctccgcgccgagccctatcggaaagtgtgcgcaccactcccaccacttcagcttggacatcgacgtgggttgcacggacctcaacgaagacctgggtgtctgggtgatcttcaagatcaagacgcaagacggacacgcgagactcggcaatctggagttcctggaggagaagcctctggtcggcgaagctctcgccagggtgaagcgcgccgagaagaagtggcgcgacaagcgggagaagctggagtgggagacgaacatcgtgtacaaggaggccaaggagtccgtggacgccctctttgtgaacagccagtacgaccgcctccaagcagacaccaacattgccatgatccacgccgccgacaagcgcgtgcactccatcagggaggcgtatctccctgaactcagcgtgattcctggcgtgaatgctgccatcttcgaggagcttgagggtcgcatcttcaccgcattcagcctctacgacgccaggaacgtcatcaagaacggagacttcaacaacgggctgtcctgctggaacgtcaaaggtcacgttgacgtggaggagcagaacaaccatcgcagcgtcctcgtcgtccctgagtgggaagctgaggtcagccaagaagtcagggtctgccctggtcgcggctacatcctcagggtgaccgcctacaaggaagggtatggtgaagggtgtgtcacgatccatgagattgagaacaacacggacgaactcaagttcagcaactgcgtcgaggaggaggtctatccgaacaacacggtcacctgcaacgactacactgccactcaggaggagtacgagggaacctacactagccgcaaccgtggctacgatggagcctacgagtccaactcctccgttcccgctgactacgcaagcgcctacgaggagaaggcgtacacggacgggcggcgcgacaacccgtgcgagtccaatcgtggctacggtgactacactccgcttcccgctggttacgtgaccaaggaacttgagtacttccctgagaccgacaaggtctggatcgagataggtgagaccgaaggcacgttcatcgttgactccgtcgaactgctgctcatggaggagtga

What is claimed is:

1. A chimeric insecticidal protein comprising the amino acid sequence as set forth in SEQ ID NO: 99 wherein the chimeric insecticidal protein exhibits inhibitory activity against an insect species of the order Lepidoptera.

2. A polynucleotide encoding the chimeric insecticidal protein of claim 1, wherein the polynucleotide is operably linked to a heterologous promoter.

3. A polynucleotide encoding a chimeric insecticidal protein, wherein the polynucleotide comprises a nucleotide sequence that a) is set forth in any of SEQ ID NO: 98 or 124, or b) encodes the chimeric insecticidal protein of claim 1.

4. A host cell comprising the polynucleotide of claim 3, wherein the host cell is selected from the group consisting of a bacterial host cell and a plant host cell.

5. The host cell of claim 4, wherein the bacterial host cell is selected from the group consisting of *Agrobacterium, Rhizobium, Bacillus, Brevibacillus, Escherichia, Pseudomonas, Klebsiella*, and *Erwinia*.

6. The host cell of claim 4, wherein the plant host cell is selected from the group of plants consisting of monocots and dicots.

7. An insect inhibitory composition comprising the chimeric insecticidal protein of claim 1.

8. The insect inhibitory composition of claim 7, further comprising at least one insect inhibitory agent different from the chimeric insecticidal protein.

9. The insect inhibitory composition of claim 8, wherein the at least one insect inhibitory agent is selected from the group consisting of an insect inhibitory protein and an insect inhibitory dsRNA molecule.

10. The insect inhibitory composition of claim 8, wherein the at least one other pesticidal agent exhibits activity against one or more pest species of the orders Lepidoptera, Coleoptera, Hemiptera, Homoptera, or Thysanoptera.

11. A seed comprising an insect inhibitory effective amount of:
   a) the chimeric insecticidal protein of claim 1; or
   b) the polynucleotide set forth in SEQ ID NO: 98 or 124.

12. A method of controlling a Lepidopteran pest, the method comprising contacting the Lepidopteran pest with an inhibitory amount of the chimeric insecticidal protein of claim 1.

13. A transgenic plant cell, plant or plant part comprising a chimeric insecticidal protein, wherein the chimeric insecticidal protein comprises SEQ ID NO: 99.

14. A method of controlling a Lepidopteran pest, comprising exposing the pest to the transgenic plant cell, plant or plant part of claim 13, wherein said plant cell, plant or plant part expresses a Lepidopteran inhibitory amount of the chimeric insecticidal protein.

15. A commodity product derived from the plant cell, plant, or plant part of claim 13, wherein the product comprises a detectable amount of the chimeric insecticidal protein.

16. The commodity product of claim 15, wherein the product is selected from the group consisting of plant biomass, oil, meal, animal feed, flour, flakes, bran, lint, hulls, and processed seed.

17. A method of producing a seed comprising the chimeric insecticidal protein of claim 1, the method comprising:
   (a) planting at least one seed comprising the chimeric insecticidal protein of claim 1;
   (b) growing plants from the seed; and
   (c) harvesting seed from said plants, wherein the harvested seed comprises the chimeric insecticidal protein of claim 1.

18. A recombinant polynucleotide molecule encoding the chimeric insecticidal protein of claim 1, said molecule comprising the full length nucleotide sequence of SEQ ID NO: 98 or 124; and a polynucleotide sequence encoding an insect inhibitory agent different from said chimeric insecticidal protein.

19. A recombinant nucleic acid molecule comprising a heterologous promoter operably linked to a polynucleotide segment encoding a chimeric insecticidal protein, wherein:
   a. the chimeric insecticidal protein comprises SEQ ID NO: 99; or
   b. the polynucleotide segment of SEQ ID NO: 98 or 124.

* * * * *